US008273944B2

(12) United States Patent
Kerns et al.

(10) Patent No.: US 8,273,944 B2
(45) Date of Patent: Sep. 25, 2012

(54) METHODS AND COMPOSITIONS FOR GRAY LEAF SPOT RESISTANCE IN CORN

(75) Inventors: Michael R. Kerns, Ankeny, IA (US); Hongwu Jia, Mystic, CT (US); David Butruille, Urbandale, IA (US); Travis J. Frey, Brentwood, MO (US); Gilberto Pozar, Uberlandia-Minas Gerais (BR); Kevin Cook, Ankeny, IA (US); Scott Walker, Cary, NC (US); Gregory Holland, Troy, OH (US)

(73) Assignee: Monsanto Technology LLC, St. Louis, MO (US)

( * ) Notice: Subject to any disclaimer, the term of this patent is extended or adjusted under 35 U.S.C. 154(b) by 708 days.

(21) Appl. No.: 12/201,008

(22) Filed: Aug. 29, 2008

(65) Prior Publication Data
US 2009/0064360 A1 Mar. 5, 2009

Related U.S. Application Data

(60) Provisional application No. 60/966,706, filed on Aug. 29, 2007.

(51) Int. Cl.
*A01H 1/00* (2006.01)
*A01H 5/00* (2006.01)
*A01H 1/02* (2006.01)
*C12Q 1/68* (2006.01)
*C07H 21/04* (2006.01)
*C12N 5/04* (2006.01)

(52) U.S. Cl. ........ 800/265; 800/301; 800/279; 800/278; 800/298; 800/320.1; 435/6.1; 435/419; 435/412

(58) Field of Classification Search .................... None
See application file for complete search history.

(56) References Cited

U.S. PATENT DOCUMENTS

| 5,574,210 | A | 11/1996 | Saghai-Maroof et al. |
| 5,749,169 | A | 5/1998 | Briggs |
| 6,399,855 | B1 | 6/2002 | Beavis |
| 7,973,212 | B2 | 7/2011 | Sebastian |
| 2007/0015164 | A1 | 1/2007 | Khatib |
| 2008/0083042 | A1 | 4/2008 | Butruille et al. |
| 2009/0064361 | A1 | 3/2009 | Butruille et al. |
| 2009/0070903 | A1 | 3/2009 | Kerns et al. |
| 2009/0172845 | A1 | 7/2009 | Li et al. |
| 2010/0146657 | A1 | 6/2010 | Butruille et al. |

FOREIGN PATENT DOCUMENTS

| WO | 2001049104 | 7/2001 |
| WO | 2007103786 | 9/2007 |
| WO | 2008021413 | 2/2008 |
| WO | 2008042185 | 10/2008 |
| WO | 2009002924 | 12/2008 |

OTHER PUBLICATIONS

Balint-Kurti et al., "Use of an Advanced Intercross Line Population for Precise Mapping of Quantitative Trait Loci for Gray Leaf Spot Resistance in Maize", Crop Science, 2008, pp. 1696-1704, vol. 48.
Coates et al., "Sources of Resistance to Gray Leaf Spot of Corn", Plant Disease, 1994, pp. 1153-1155, vol. 78 No. 12.
Coates et al., "Inheritance of Resistance to Gray Leaf Sport in Crosses Involving Selected Resistant Inbred Lines of Corn", Phytopathology, 1998, pp. 972-982, vol. 88 No. 9.
Gordon et al., "Linkage of Molecular Markers to Cercospora zeae-maydis Resistance in Maize", Crop Science, 2004, pp. 628-636, vol. 44.
Juliatti et al., "Genetic mapping for resistance to gray leaf spot in maize", Euphytica, 2009, pp. 227-238, vol. 169.
Danson et al., "Quantitative trait loci (QTLs) for resistance to gray leaf spot and common rust diseases of maize", African Journal of Biotechnology, 2008, pp. 3247-3254, vol. 7 No. 18.
Derera et al., "Gene Action Controlling Gray Leaf Spot Resistance in Southern African Maize Germplasm", Crop Science, 2008, pp. 93-98, vol. 48.
Pozar et al., "Mapping and validation of quantitative trait loci for resistance to Cercospora zeae-maydis infection in tropical maize (*Zea mays* L.)", Theoretical and Applied Genetics, 2009, pp. 553-564, vol. 118.
Chen et al, "Genetic Analysis of Anther-Derived Plants of Rice", The Journal of Heredity, 1982, pp. 49-52, vol. 73.
Yadav et al., "Mapping Genes Controlling Root Morphology and Root Distribution in a Doubled-Haploid Population of Rice", Theoretical and Applied Genetics, 1997, pp. 619-632, vol. 94.
Wych, Robert D., "Production of Hybrid Seed Corn", Corn and Corn Improvement (Third Edition), 1988, pp. 565-607, No. 18 in the series "Agronomy".
Greenland et al., "Reversible male sterility: a novel system for the production of hybrid corn", Symp Soc Exp Biol, 1998, pp. 141-147, vol. 51.
Bink et al., "Fine Mapping of Quantitative Trait Loci Using Linkage Disequilibrium in Inbred Plant Populations", Euphytica, 2004, pp. 95-99, vol. 137.
Paul, P.A., et al., Regression and Artificial Neural Network Modeling for the Prediction of Gray Leaf Spot of Maize, Phytopathology, 2005, pp. 388-396, vol. 95.
Ward, Julian M., et al., Gray Leaf Spot: A Disease of Global Importance in Maize Production, Plant Disease, 1999, pp. 884-895, vol. 83 No. 10. Saghai Maroof, M.A., et al., Identification of quantitative trait loci controlling resistance to gray leaf spot disease in Maize, Theoretical and Applied Genetics, 1996, pp. 539-546, vol. 93.
Carson, M.L., et al., Pathogenicity, Aggressiveness, and Virulence of Three Species of Cercospora Associated with Gray Leaf Spot of Maize, Maydica, 2006, pp. 89-92, vol. 51.
Carson, M.L., et al., Variation in Agressiveness Among Isolates of Cercospora from Maize as a Potential Cause of Genotype-environment Interation in Gray Leaf Spot Trials, Plant Disease, Oct. 2002, pp. 1089-1093, vol. 86.
Lehmensiek, A., et al., Genetic mapping of gray leaf spot (GlS) resistance genes in maize, Theoretical and Applied Genetics, 2001, pp. 797-803, vol. 103.
Clements, M.J., et al., Quantitative Trait Loci Associated with Resistance to Gray Leaf Spot of Corn, Phytopathology, 2000, pp. 1018-1025, vol. 90, No. 9.
Gordon, Stuart G., et al., Linkage of Molecular Markers to Cercospora zeae-maydis Resistance in Maize, Crop Science, 2004, pp. 628-636, vol. 44.

(Continued)

*Primary Examiner* — Medina A Ibrahim
(74) *Attorney, Agent, or Firm* — Thompson Coburn LLP

(57) ABSTRACT

The present invention relates to the field of plant breeding. More specifically, the present invention includes a method of using haploid plants for genetic mapping of traits of interest such as disease resistance. Further, the invention includes a method for breeding corn plants containing quantitative trait loci (QTL) that are associated with resistance to Gray Leaf Spot, a fungal disease associated with *Cercospora* spp.

16 Claims, 96 Drawing Sheets

OTHER PUBLICATIONS

Bubeck, D.M., et al., Quantitative Trait Loci Controlling Resistance to Gray Leaf Spot in Maize, Crop Science, 1993, pp. 838-847, vol. 33.

Saghai Maroof, M.A., et al., Analysis of the barley and rice genomes by comparative RFLP linkage mapping, Theoretical and Applied Genetics, 1996, pp. 541-551, vol. 92.

Lander, Eric S., et al., Mapping Mendelian Factors Underlying Quantitative Traits Using RFLP Linkage Maps, Genetics, Jan. 1989, pp. 185-199, vol. 121.

Arús, P., et al., Marker-assisted selection, Plant Breeding: Principles and Prospects, 1993, pp. 314-331, Chapman & Hall, London.

Kruglyak, Leonid, et al., A Nonparametric Approach for Mapping Quantitative Trait Loci, Genetics, Mar. 1995, pp. 1421-1428, vol. 139.

Jansen, Ritsert C., Mapping of quantitative trait loci by using genetic markers: an overview of biometrical models used, Biometrics in Plant Breeding: Applications of Molecular Markers, Proceedings of the Ninth Meeting of the Eucarpia Section Biometrics in Plant Breeding, van Oijen, Jansen (eds.), 1994, pp. 116-124, The Netherlands.

Jansen, Ritsert C., et al., High Resolution of Quantitative Traits Into Multiple Loci via Interval Mapping, Genetics, Apr. 1994, pp. 1447-1455, vol. 136.

Zeng, Zhao-Bang, Precision Mapping of Quantitative Trait Loci, Genetics, Apr. 1994, pp. 1457-1468, vol. 136.

Utz, H.F., et al., Comparison of different approaches to interval mapping of quantitative trait loci, Biometrics in Plant Breeding: Applications of Molecular Markers, Proceedings of the Ninth Meeting of the Eucarpia Section Biometrics in Plant Breeding, van Oijen, Jansen (eds.), 1994, pp. 195-204, The Netherlands.

Jansen, R.C., et al., Genotype-by-environment interaction in genetic mapping of multiple quantitative trail loci, Theoretical and Applied Genetics, 1995, pp. 33-37, vol. 91.

Tanksley, Steven D., et al., Molecular mapping of plant chromosomes, Chromosome structure and function: Impact of new concepts, 1988, pp. 157-173, J.P. Gustafson and R. Appels (eds.), Plenum Press, New York.

Fan, Ruzong, et al., High-Resolution Association Mapping of Quantitative Trait Loci: A Population-Based Approach, Genetics, Jan. 2006, pp. 663-686, vol. 172.

Excoffier, Laurent, et al., Maximum-Likelihood Estimation of Molecular Haplotype Frequencies in a Diploid Population, Molecular Biology and Evolution, 1995, pp. 921-927, vol. 12 No. 5.

Li, Hongzhe, et al., Multivariate survival models induced by genetic frailties, with application to linkage analysis, Biostatistics, 2002, pp. 57-75, vol. 3.

Dempster, A.P., et al., Maximum Likelihood from Incomplete Data via the EM Algorithm, Journal of the Royal Statistical Society, 1977, pp. 1-38, vol. 39 No. 1.

Li, Jing, et al., Haplotype-based quantitative trait mapping using a clustering algorithm, BMC Bioinformatics, May 18, 2006, pp. 1-11, vol. 7 No. 258.

| QTL | Marker | Chr | pos | sig | effect | res allele | Mapping Study | Fav. Parent | SNP Position | SEQ ID |
|---|---|---|---|---|---|---|---|---|---|---|
| 1 | NC0111829 | 1 | 0.3 | 0.034236 | 0.009483 | G | Study 1 | I283669 | 142 | 1 |
| 1 | NC0024027 | 1 | 1 | 0.0003 | 0.102336 | T | Study 3 | -- | 141 | 2 |
| 1 | NC0024027 | 1 | 1 | -- | -- | T | Study 4 | -- | 141 | 2 |
| 1 | NC0024027 | 1 | 1 | 0.000436 | 0.025925 | C | Study 1 | CV048 | 141 | 2 |
| 1 | NC0024027 | 1 | 1 | 0.013509 | -0.0515 | C | Study 1 | CV082 | 141 | 2 |
| 1 | NC0015697 | 1 | 1.4 | 0.043777 | 0.005404 | G | Study 1 | CV024 | 585 | 3 |
| 1 | NC0002640 | 1 | 2.6 | 0.029802 | 0.003489 | T | Study 1 | CV099 | 383 | 4 |
| 1 | NC0002640 | 1 | 2.6 | 0.011823 | -0.01651 | C | Study 1 | CV113 | 383 | 4 |
| 1 | NC0019086 | 1 | 5.7 | 0.013874 | -0.05083 | C | Study 1 | CV082 | 401 | 5 |
| 1 | NC0019524 | 1 | 5.8 | 0.009251 | 0.012704 | C | Study 1 | I283669 | 338 | 6 |
| 1 | NC0033261 | 1 | 5.8 | 0.026044 | 0.064082 | G | Study 1 | CV128 | 92 | 7 |
| 1 | NC0147181 | 1 | 6.7 | 0.009497 | 0.016068 | G | Study 1 | I283669 | 147 | 8 |
| 1 | NC0147181 | 1 | 6.7 | 0.015544 | 0.185539 | G | Study 1 | CV125 | 147 | 8 |
| 1 | NC0147181 | 1 | 6.7 | 0.001425 | 0.112232 | G | Study 1 | CV079 | 147 | 8 |
| 1 | NC0147202 | 1 | 6.7 | 0.038382 | -0.01465 | T | Study 1 | CV010 | 509 | 9 |
| 1 | NC0111443 | 1 | 10.3 | <.0001 | -0.28289 | A | Study 3 | -- | 367 | 10 |
| 2 | NC0043992 | 1 | 13.2 | 0.016852 | -0.00981 | A | Study 1 | CV099 | 47 | 11 |
| 2 | NC0043992 | 1 | 13.2 | 0.016466 | 0.082878 | A | Study 1 | CV126 | 47 | 11 |
| 2 | NC0043994 | 1 | 13.2 | 0.008489 | 0.011912 | A | Study 1 | I283669 | 249 | 12 |
| 2 | NC0043994 | 1 | 13.2 | 0.00067 | 0.021438 | C | Study 1 | I283669 | 249 | 12 |
| 2 | NC0154927 | 1 | 18.5 | 0.027528 | 0.018791 | C | Study 1 | CV161 | 350 | 13 |
| 2 | NC0070876 | 1 | 19.7 | 0.035824 | 0.009816 | G | Study 1 | I283669 | 438 | 14 |
| 2 | NC0070876 | 1 | 19.7 | 0.000071 | 0.023793 | G | Study 1 | I283669 | 438 | 14 |
| 2 | NC0070876 | 1 | 19.7 | 0.006703 | -0.01111 | C | Study 1 | CV099 | 438 | 14 |
| 3 | NC0066743 | 1 | 20.2 | 0.030831 | 0.005416 | -- | Study 1 | CV024 | 595 | 15 |
| 3 | NC0036199 | 1 | 20.6 | 0.020915 | 0.025886 | A | Study 1 | CV165 | 183 | 16 |
| 3 | NC0036199 | 1 | 20.6 | 0.028426 | 0.021429 | A | Study 1 | CV165 | 183 | 16 |
| 3 | NC0043185 | 1 | 22.6 | 0.025856 | -0.01032 | G | Study 1 | CV082 | 230 | 17 |
| 3 | NC0078736 | 1 | 24.3 | -- | -- | . | Study 4 | -- | 289 | 18 |
| 3 | NC0078736 | 1 | 24.3 | 0.01126 | 0.089712 | C | Study 1 | CV079 | 289 | 18 |
| 3 | NC0078736 | 1 | 24.3 | 0.000968 | -0.01927 | . | Study 1 | CV093 | 289 | 18 |
| 3 | NC0110473 | 1 | 24.6 | 0.001947 | -0.01904 | G | Study 1 | CV093 | 194 | 19 |
| 3 | NC0025418 | 1 | 26.4 | 0.000113 | 0.028173 | ATC | Study 1 | CV048 | 225 | 20 |

| QTL | Marker | Chr | pos | sig | effect | res allele | Mapping Study | Fav. Parent | SNP Position | SEQ ID |
|---|---|---|---|---|---|---|---|---|---|---|
| 3 | NC0025418 | 1 | 26.4 | 0.004849 | 0.007089 | ATC | Study 1 | CV137 | 225 | 20 |
| 3 | NC0025418 | 1 | 26.4 | 0.014859 | 0.00354 | ATC | Study 1 | CV016 | 225 | 20 |
| 3 | NC0025418 | 1 | 26.4 | 0.014859 | 0.00354 | ATC | Study 1 | CV016 | 225 | 20 |
| 3 | NC0083894 | 1 | 26.5 | -- | -- | C | Study 4 | -- | 118 | 21 |
| 3 | NC0147302 | 1 | 27.6 | 0.044474 | -0.00532 | T | Study 1 | CV088 | 146 | 22 |
| 3 | NC0147302 | 1 | 27.6 | 0.000008 | 0.025871 | T | Study 1 | I283669 | 146 | 22 |
| 3 | NC0147302 | 1 | 27.6 | 0.00324 | 0.005147 | T | Study 1 | CV099 | 146 | 22 |
| 3 | NC0147302 | 1 | 27.6 | 0.027879 | -0.01508 | C | Study 1 | CV072 | 146 | 22 |
| 4 | NC0028164 | 1 | 30.1 | 0.000049 | 0.139947 | G | Study 1 | CV082 | 237 | 23 |
| 4 | NC0028164 | 1 | 30.1 | 0.000896 | 0.014317 | G | Study 1 | I283669 | 237 | 23 |
| 4 | NC0028164 | 1 | 30.1 | 0.001984 | -0.01302 | G | Study 1 | CV099 | 237 | 23 |
| 4 | NC0028164 | 1 | 30.1 | 0.009606 | 0.007389 | G | Study 1 | CV099 | 237 | 23 |
| 4 | NC0028164 | 1 | 30.1 | 0.016764 | 0.128532 | C | Study 1 | CV149 | 237 | 23 |
| 4 | NC0028164 | 1 | 30.1 | 0.027912 | 0.0126 | G | Study 1 | CV159 | 237 | 23 |
| 4 | NC0105051 | 1 | 31.4 | 0.019187 | -0.01483 | G | Study 1 | CV059 | 426 | 24 |
| 4 | NC0105051 | 1 | 31.4 | 0.015324 | 0.072924 | C | Study 1 | CV131 | 426 | 24 |
| 4 | NC0105051 | 1 | 31.4 | 0.000114 | 0.019807 | C | Study 1 | I283669 | 426 | 24 |
| 4 | NC0105051 | 1 | 31.4 | 0 | 0.043188 | C | Study 1 | I283669 | 426 | 24 |
| 4 | NC0105051 | 1 | 31.4 | 0.015229 | -0.02083 | C | Study 1 | CV064 | 426 | 24 |
| 4 | NC0108303 | 1 | 31.7 | 0.001007 | -0.08946 | T | Study 1 | CV050 | 543 | 25 |
| 4 | NC0107227 | 1 | 34.1 | 0.009677 | -0.33157 | A | Study 1 | CV130 | 54 | 26 |
| 4 | NC0107227 | 1 | 34.1 | 0.004623 | -0.01701 | G | Study 1 | CV093 | 54 | 26 |
| 4 | NC0003563 | 1 | 34.5 | -- | -- | G | Study 4 | -- | 434 | 27 |
| 4 | NC0003563 | 1 | 34.5 | 0.006903 | 0.11343 | G | Study 1 | CV166 | 434 | 27 |
| 4 | NC0003563 | 1 | 34.5 | 0.021161 | 0.066975 | G | Study 1 | CV050 | 434 | 27 |
| 4 | NC0003563 | 1 | 34.5 | 0.021183 | 0.119208 | G | Study 1 | CV125 | 434 | 27 |
| 4 | NC0003563 | 1 | 34.5 | 0.043858 | 0.012263 | G | Study 1 | CV079 | 434 | 27 |
| 4 | NC0003563 | 1 | 34.5 | 0.006671 | 0.022899 | G | Study 1 | CV161 | 434 | 27 |
| 4 | NC0003563 | 1 | 34.5 | 0.031036 | -0.02487 | A | Study 1 | I294213 | 434 | 27 |
| 4 | NC0003563 | 1 | 34.5 | 0.019434 | -0.02797 | A | Study 1 | CV112 | 434 | 27 |
| 4 | NC0003563 | 1 | 34.5 | 0.02093 | 0.082079 | G | Study 1 | CV079 | 434 | 27 |
| 4 | NC0113465 | 1 | 34.6 | 0.001084 | 0.024464 | T | Study 1 | CV048 | 80 | 28 |
| 4 | NC0113465 | 1 | 34.6 | 0.014827 | 0.149222 | T | Study 1 | CV159 | 80 | 28 |

CONT.

| QTL | Marker | Chr | pos | sig | effect | res allele | Mapping Study | Fav. Parent | SNP Position | SEQ ID |
|---|---|---|---|---|---|---|---|---|---|---|
| 4 | NC0113465 | 1 | 34.6 | 0.022392 | 0.013463 | T | Study 1 | CV159 | 80 | 28 |
| 4 | NC0113465 | 1 | 34.6 | 0.001032 | 0.036529 | T | Study 1 | CV165 | 80 | 28 |
| 4 | NC0113465 | 1 | 34.6 | 0.003918 | 0.028134 | T | Study 1 | CV165 | 80 | 28 |
| 4 | NC0199573 | 1 | 37.2 | -- | -- | T | Study 5 | -- | 105 | 29 |
| 4 | NC0144205 | 1 | 38.5 | 0 | 0.03375 | T | Study 1 | I283669 | 139 | 30 |
| 4 | NC0144205 | 1 | 38.5 | 0.000055 | 0.013897 | T | Study 1 | I283669 | 139 | 30 |
| 4 | NC0144205 | 1 | 38.5 | 0 | 0.029586 | T | Study 1 | I283669 | 139 | 30 |
| 4 | NC0144205 | 1 | 38.5 | 0.00372 | 0.007952 | T | Study 1 | CV099 | 139 | 30 |
| 4 | NC0144205 | 1 | 38.5 | 0.000672 | 0.005994 | T | Study 1 | CV099 | 139 | 30 |
| 5 | NC0033770 | 1 | 40.3 | 0.001014 | -0.0145 | G | Study 1 | CV099 | 75 | 31 |
| 5 | NC0033770 | 1 | 40.3 | 0.010585 | 0.139469 | C | Study 1 | CV069 | 75 | 31 |
| 5 | NC0033770 | 1 | 40.3 | 0.012479 | 0.143546 | C | Study 1 | CV160 | 75 | 31 |
| 5 | NC0033770 | 1 | 40.3 | 0.047338 | 0.058002 | C | Study 1 | CV150 | 75 | 31 |
| 5 | NC0033770 | 1 | 40.3 | 0.004807 | 0.091916 | C | Study 1 | CV150 | 75 | 31 |
| 5 | NC0038710 | 1 | 43.8 | 0.040524 | -0.08462 | A | Study 1 | CV045 | 360 | 32 |
| 5 | NC0038710 | 1 | 43.8 | 0.01384 | 0.193651 | A | Study 1 | CV125 | 360 | 32 |
| 5 | NC0110871 | 1 | 44.6 | 0.039621 | 0.164179 | C | Study 1 | CV073 | 378 | 33 |
| 5 | NC0036685 | 1 | 45.8 | 0.035372 | -0.11269 | G | Study 1 | CV053 | 203 | 34 |
| 5 | NC0036685 | 1 | 45.8 | 0.018271 | -0.19102 | A | Study 1 | CV069 | 203 | 34 |
| 5 | NC0036685 | 1 | 45.8 | 0.00009 | 0.140649 | G | Study 1 | CV082 | 203 | 34 |
| 5 | NC0036685 | 1 | 45.8 | 0.001189 | 0.17425 | A | Study 1 | CV149 | 203 | 34 |
| 5 | NC0036685 | 1 | 45.8 | 0.048917 | 0.057356 | A | Study 1 | CV150 | 203 | 34 |
| 5 | NC0036685 | 1 | 45.8 | 0.006246 | 0.089307 | A | Study 1 | CV150 | 203 | 34 |
| 5 | NC0036685 | 1 | 45.8 | 0.014557 | -0.02024 | G | Study 1 | CV063 | 203 | 34 |
| 5 | NC0029694 | 1 | 46 | 0.000543 | 0.15273 | C | Study 1 | CV133 | 78 | 35 |
| 5 | NC0029694 | 1 | 46 | 0.045977 | -0.01474 | G | Study 1 | CV041 | 78 | 35 |
| 5 | NC0052741 | 1 | 49.5 | 0.000043 | 0.02962 | G | Study 1 | CV048 | 411 | 36 |
| 5 | NC0052741 | 1 | 49.5 | 0.000095 | -0.02772 | G | Study 1 | CV139 | 411 | 36 |
| 5 | NC0052741 | 1 | 49.5 | 0.013103 | -0.11301 | G | Study 1 | CV068 | 411 | 36 |
| 5 | NC0052741 | 1 | 49.5 | 0.012332 | -0.06657 | G | Study 1 | CV011 | 411 | 36 |
| 5 | NC0052741 | 1 | 49.5 | 0.005353 | 0.087885 | G | Study 1 | CV131 | 411 | 36 |
| 5 | NC0052741 | 1 | 49.5 | 0 | 0.035716 | G | Study 1 | I283669 | 411 | 36 |
| 5 | NC0052741 | 1 | 49.5 | 0 | 0.034619 | G | Study 1 | I283669 | 411 | 36 |

CONT.

| QTL | Marker | Chr | pos | sig | effect | res allele | Mapping Study | Fav. Parent | SNP Position | SEQ ID |
|---|---|---|---|---|---|---|---|---|---|---|
| 5 | NC0052741 | 1 | 49.5 | 0.00012 | 0.012778 | G | Study 1 | I283669 | 411 | 36 |
| 5 | NC0052741 | 1 | 49.5 | 0.025035 | 0.015256 | G | Study 1 | CV049 | 411 | 36 |
| 5 | NC0052741 | 1 | 49.5 | 0.004544 | 0.123091 | G | Study 1 | CV125 | 411 | 36 |
| 5 | NC0052741 | 1 | 49.5 | 0.03081 | 0.133684 | G | Study 1 | CV159 | 411 | 36 |
| 5 | NC0052741 | 1 | 49.5 | 0.026453 | 0.131758 | G | Study 1 | CV157 | 411 | 36 |
| 5 | NC0052741 | 1 | 49.5 | 0.000397 | 0.093446 | G | Study 1 | CV050 | 411 | 36 |
| 5 | NC0052741 | 1 | 49.5 | 0.002057 | 0.156236 | G | Study 1 | CV125 | 411 | 36 |
| 5 | NC0052741 | 1 | 49.5 | 0.000872 | 0.009598 | G | Study 1 | CV024 | 411 | 36 |
| 5 | NC0052741 | 1 | 49.5 | 0.015105 | -0.01269 | G | Study 1 | CV136 | 411 | 36 |
| 5 | NC0052741 | 1 | 49.5 | 0.023099 | 0.013786 | G | Study 1 | CV142 | 411 | 36 |
| 5 | NC0052741 | 1 | 49.5 | 0.02095 | -0.01098 | G | Study 1 | CV088 | 411 | 36 |
| 5 | NC0052741 | 1 | 49.5 | 0.038429 | -0.03621 | G | Study 1 | CV010 | 411 | 36 |
| 5 | NC0052741 | 1 | 49.5 | 0.021643 | -0.00531 | G | Study 1 | CV010 | 411 | 36 |
| 5 | NC0052741 | 1 | 49.5 | 0.000876 | -0.03117 | G | Study 1 | CV010 | 411 | 36 |
| 5 | NC0052741 | 1 | 49.5 | 0.00077 | 0.037249 | G | Study 1 | CV165 | 411 | 36 |
| 5 | NC0052741 | 1 | 49.5 | 0.004239 | 0.027689 | C | Study 1 | CV165 | 411 | 36 |
| 5 | NC0052741 | 1 | 49.5 | 0.000016 | 0.028741 | G | Study 1 | CV144 | 411 | 36 |
| 5 | NC0049734 | 1 | 49.9 | - | - | T | Study 5 | - | 462 | 37 |
| 6 | NC0043571 | 1 | 50.3 | 0.045184 | -0.07373 | C | Study 1 | CV041 | 336 | 38 |
| 6 | NC0043571 | 1 | 50.3 | 0.011319 | -0.095 | C | Study 1 | CV101 | 336 | 38 |
| 6 | NC0038720 | 1 | 50.5 | <.0001 | -0.26363 | C | Study 3 | - | 378 | 39 |
| 6 | NC0038720 | 1 | 50.5 | 0.000072 | -0.01561 | T | Study 1 | CV105 | 378 | 39 |
| 6 | NC0038720 | 1 | 50.5 | 0.008965 | 0.112503 | C | Study 1 | CV125 | 378 | 39 |
| 6 | NC0038720 | 1 | 50.5 | 0.004588 | 0.004643 | C | Study 1 | CV099 | 378 | 39 |
| 6 | NC0148102 | 1 | 50.5 | - | - | G | Study 4 | - | 163 | 40 |
| 6 | NC0148102 | 1 | 50.5 | 0.033516 | -0.05757 | G | Study 1 | CV050 | 163 | 40 |
| 6 | NC0148102 | 1 | 50.5 | 0.030411 | 0.091659 | G | Study 1 | CV166 | 163 | 40 |
| 6 | NC0009213 | 1 | 51.3 | 0.030527 | -0.05804 | T | Study 1 | CV057 | 98 | 41 |
| 6 | NC0035417 | 1 | 51.3 | 0.02657 | 0.018413 | G | Study 1 | CV161 | 176 | 42 |
| 6 | NC0035417 | 1 | 51.3 | 0.000001 | 0.175452 | G | Study 1 | CV126 | 176 | 42 |
| 6 | NC0035417 | 1 | 51.3 | 0.015318 | 0.086552 | G | Study 1 | CV079 | 176 | 42 |
| 6 | NC0035417 | 1 | 51.3 | 0.024656 | 0.089317 | G | Study 1 | CV079 | 176 | 42 |
| 6 | NC0041877 | 1 | 51.3 | 0.048151 | 0.009565 | **** | Study 1 | CV069 | 77 | 43 |

CONT.

| QTL | Marker | Chr | pos | sig | effect | res allele | Mapping Study | Fav. Parent | SNP Position | SEQ ID |
|---|---|---|---|---|---|---|---|---|---|---|
| 6 | NC0056126 | 1 | 51.3 | <.0001 | -0.14446 | A | Study 3 | -- | 250 | 44 |
| 6 | NC0056126 | 1 | 51.3 | 0.020534 | 0.134419 | A | Study 1 | CV160 | 250 | 44 |
| 6 | NC0152452 | 1 | 56.8 | 0 | 0.030349 | G | Study 1 | I283669 | 345 | 45 |
| 6 | NC0152452 | 1 | 56.8 | 0.000201 | -0.01555 | G | Study 1 | CV099 | 345 | 45 |
| 6 | NC0152452 | 1 | 56.8 | 0.009202 | 0.004278 | G | Study 1 | CV099 | 345 | 45 |
| 6 | NC0108891 | 1 | 58.2 | -- | -- | T | Study 5 | -- | 562 | 46 |
| 6 | NC0113273 | 1 | 58.2 | -- | -- | C | Study 5 | -- | 111 | 47 |
| 6 | NC0113273 | 1 | 58.2 | 0.010104 | 0.017704 | C | Study 1 | CV049 | 111 | 47 |
| 6 | NC0113273 | 1 | 58.2 | 0.017765 | -0.09709 | C | Study 1 | CV045 | 111 | 47 |
| 6 | NC0113273 | 1 | 58.2 | 0.000455 | 0.02701 | G | Study 1 | CV144 | 111 | 47 |
| 6 | NC0080697 | 1 | 58.4 | -- | -- | G | Study 5 | -- | 484 | 48 |
| 6 | NC0080697 | 1 | 58.4 | 0.000028 | 0.145589 | A | Study 1 | CV082 | 484 | 48 |
| 6 | NC0080697 | 1 | 58.4 | 0.0369 | -0.01739 | A | Study 1 | CV063 | 484 | 48 |
| 6 | NC0080697 | 1 | 58.4 | 0.028596 | -0.013344 | A | Study 1 | CV065 | 484 | 48 |
| 7 | NC0042173 | 1 | 60.2 | 0.002196 | 0.022689 | TA | Study 1 | CV048 | 91 | 49 |
| 7 | NC0042173 | 1 | 60.2 | 0.006409 | -0.13106 | TA | Study 1 | CV069 | 91 | 49 |
| 7 | NC0042173 | 1 | 60.2 | 0.014415 | -0.1113 | TA | Study 1 | CV068 | 91 | 49 |
| 7 | NC0042173 | 1 | 60.2 | 0.000021 | 0.234914 | TA | Study 1 | CV069 | 91 | 49 |
| 7 | NC0042173 | 1 | 60.2 | 0.000945 | -0.12081 | TA | Study 1 | CV101 | 91 | 49 |
| 7 | NC0042173 | 1 | 60.2 | 0.025031 | -0.09162 | TA | Study 1 | CV075 | 91 | 49 |
| 7 | NC0042173 | 1 | 60.2 | 0.013984 | 0.144166 | TA | Study 1 | CV070 | 91 | 49 |
| 7 | NC0042173 | 1 | 60.2 | 0.000045 | 0.228173 | ** | Study 1 | CV149 | 91 | 49 |
| 7 | NC0113502 | 1 | 63.5 | 0.001208 | -0.19751 | C | Study 1 | CV131 | 447 | 50 |
| 7 | NC0113502 | 1 | 63.5 | 0.000173 | 0.018895 | G | Study 1 | I283669 | 447 | 50 |
| 7 | NC0113502 | 1 | 63.5 | 0 | 0.02299 | G | Study 1 | I283669 | 447 | 50 |
| 7 | NC0113502 | 1 | 63.5 | 0.030901 | -0.000922 | C | Study 1 | CV010 | 447 | 50 |
| 7 | NC0113502 | 1 | 63.5 | 0.001839 | -0.08363 | C | Study 1 | CV050 | 447 | 50 |
| 7 | NC0113502 | 1 | 63.5 | 0.015829 | 0.013654 | C | Study 1 | CV142 | 447 | 50 |
| 7 | NC0113502 | 1 | 63.5 | 0.023512 | -0.03917 | C | Study 1 | CV010 | 447 | 50 |
| 7 | NC0113502 | 1 | 63.5 | 0.01846 | -0.005539 | C | Study 1 | CV010 | 447 | 50 |
| 7 | NC0029329 | 1 | 65.8 | -- | -- | T | Study 4 | -- | 497 | 51 |
| 7 | NC0029329 | 1 | 65.8 | 0.044228 | 0.086584 | C | Study 1 | CV166 | 497 | 51 |
| 7 | NC0029329 | 1 | 65.8 | 0.005862 | 0.162589 | C | Study 1 | CV070 | 497 | 51 |

CONT.

| QTL | Marker | Chr | pos | sig | effect | res allele | Mapping Study | Fav. Parent | SNP Position | SEQ ID |
|---|---|---|---|---|---|---|---|---|---|---|
| 7 | NC0039205 | 1 | 65.8 | 0.000008 | -0.01826 | C | Study 1 | CV099 | 233 | 52 |
| 7 | NC0039205 | 1 | 65.8 | 0.016827 | 0.012547 | C | Study 1 | CV069 | 233 | 52 |
| 7 | NC0039840 | 1 | 65.8 | 0.003155 | 0.131939 | G | Study 1 | CV133 | 82 | 53 |
| 7 | NC0174834 | 1 | 65.8 | -- | -- | C | Study 5 | -- | 266 | 54 |
| 7 | NC0000116 | 1 | 66 | 0.026555 | -0.20549 | G | Study 4 | -- | 284 | 55 |
| 7 | NC0000116 | 1 | 66 | 0.011547 | 0.021667 | G | Study 1 | CV088 | 284 | 55 |
| 7 | NC0000116 | 1 | 66 | 0.011475 | 0.014501 | G | Study 1 | CV161 | 284 | 55 |
| 7 | NC0000116 | 1 | 66 | 0.000473 | 0.193665 | G | Study 1 | CV142 | 284 | 55 |
| 7 | NC0000116 | 1 | 66 | 0.001382 | 0.03547 | A | Study 1 | CV160 | 284 | 55 |
| 7 | NC0000116 | 1 | 66 | 0.027098 | 0.021496 | A | Study 1 | CV165 | 284 | 55 |
| 7 | NC0000116 | 1 | 66 | 0.046525 | 0.009233 | A | Study 1 | CV165 | 284 | 55 |
| 7 | NC0000116 | 1 | 66 | 0.046525 | 0.009233 | A | Study 1 | CV012 | 284 | 55 |
| 7 | NC0000116 | 1 | 66 | 0 | 0.037243 | G | Study 1 | CV012 | 284 | 55 |
| 7 | NC0009159 | 1 | 66 | -- | -- | T | Study 1 | I283669 | 360 | 56 |
| 7 | NC0040189 | 1 | 66.4 | 0.000159 | -0.01501 | C | Study 4 | -- | 325 | 57 |
| 7 | NC0040189 | 1 | 66.4 | 0.000277 | -0.28652 | C | Study 1 | CV105 | 325 | 57 |
| 7 | NC0040189 | 1 | 66.4 | 0.000238 | -0.02492 | T | Study 1 | CV069 | 325 | 57 |
| 7 | NC0040189 | 1 | 66.4 | 0.000017 | 0.153607 | C | Study 1 | CV072 | 325 | 57 |
| 7 | NC0200213 | 1 | 67.4 | -- | -- | G | Study 5 | CV126 | 39 | 58 |
| 8 | NC0057022 | 1 | 70.1 | 0.0003 | 0.122684 | T | Study 3 | -- | 100 | 59 |
| 8 | NC0014299 | 1 | 70.2 | 0.000533 | 0.207116 | G | Study 1 | CV157 | 488 | 60 |
| 8 | NC0033819 | 1 | 70.2 | 0.039358 | 0.002775 | A | Study 1 | CV024 | 320 | 61 |
| 8 | NC0033819 | 1 | 70.2 | 0.000016 | 0.016151 | G | Study 1 | I283669 | 320 | 61 |
| 8 | NC0033819 | 1 | 70.2 | 0.014562 | 0.004324 | G | Study 1 | CV099 | 320 | 61 |
| 8 | NC0033819 | 1 | 70.2 | 0.002104 | -0.08032 | A | Study 1 | CV057 | 320 | 61 |
| 8 | NC0038788 | 1 | 70.7 | -- | -- | T | Study 5 | -- | 380 | 62 |
| 8 | NC0018320 | 1 | 72.4 | 0.003426 | 0.171713 | C | Study 1 | CV070 | 136 | 63 |
| 8 | NC0018281 | 1 | 72.5 | 0.000045 | -0.501 | A | Study 1 | CV130 | 248 | 64 |
| 8 | NC0009578 | 1 | 73.5 | -- | -- | G | Study 5 | -- | 208 | 65 |
| 8 | NC0009578 | 1 | 73.5 | 0.016603 | 0.017902 | A | Study 1 | CV048 | 208 | 65 |
| 8 | NC0009578 | 1 | 73.5 | 0.000057 | 0.121862 | A | Study 1 | CV131 | 208 | 65 |
| 8 | NC0009578 | 1 | 73.5 | 0 | 0.028927 | A | Study 1 | I283669 | 208 | 65 |

CONT.

| QTL | Marker | Chr | pos | sig | effect | res allele | Mapping Study | Fav. Parent | SNP Position | SEQ ID |
|---|---|---|---|---|---|---|---|---|---|---|
| 8 | NC0146543 | 1 | 73.7 | -- | -- | T | Study 4 | -- | 269 | 66 |
| 8 | NC0146543 | 1 | 73.7 | 0.000742 | -0.12321 | T | Study 1 | CV101 | 269 | 66 |
| 8 | NC0155962 | 1 | 73.7 | -- | -- | G | Study 5 | -- | 659 | 67 |
| 8 | NC0016876 | 1 | 74.9 | 0.005905 | 0.078776 | G | Study 2 | -- | 91 | 68 |
| 8 | NC0016876 | 1 | 74.9 | 0.014302 | 0.014671 | A | Study 1 | CV150 | 91 | 68 |
| 8 | NC0039067 | 1 | 75.4 | -- | -- | T | Study 4 | -- | 172 | 69 |
| 8 | NC0039067 | 1 | 75.4 | 0.000157 | -0.01491 | C | Study 1 | CV105 | 172 | 69 |
| 8 | NC0039067 | 1 | 75.4 | 0.000078 | 0.207134 | C | Study 1 | CV069 | 172 | 69 |
| 8 | NC0039067 | 1 | 75.4 | 0.041629 | 0.006761 | C | Study 1 | CV102 | 172 | 69 |
| 8 | NC0039812 | 1 | 77.8 | 0.0002 | 0.106174 | T | Study 3 | -- | 75 | 70 |
| 8 | NC0039812 | 1 | 77.8 | -- | -- | T | Study 4 | CV137 | 75 | 70 |
| 8 | NC0039812 | 1 | 77.8 | 0.002254 | 0.012704 | T | Study 1 | CV137 | 75 | 70 |
| 8 | NC0039812 | 1 | 77.8 | 0.021728 | 0.010835 | A | Study 1 | I283669 | 75 | 70 |
| 8 | NC0105022 | 1 | 79.5 | -- | -- | G | Study 4 | -- | 63 | 71 |
| 8 | NC0105022 | 1 | 79.5 | 0.000714 | 0.014095 | G | Study 1 | CV137 | 63 | 71 |
| 8 | NC0105022 | 1 | 79.5 | 0.000009 | 0.338016 | G | Study 1 | CV073 | 63 | 71 |
| 8 | NC0105022 | 1 | 79.5 | 0.003632 | 0.15662 | G | Study 1 | CV149 | 63 | 71 |
| 8 | NC0105022 | 1 | 79.5 | 0.003365 | 0.172231 | G | Study 1 | CV070 | 63 | 71 |
| 8 | NC0105022 | 1 | 79.5 | 0.01818 | 0.013491 | G | Study 1 | CV142 | 63 | 71 |
| 8 | NC0105022 | 1 | 79.5 | 0.018075 | -0.01554 | T | Study 1 | CV077 | 63 | 71 |
| 8 | NC0077749 | 1 | 79.6 | 0.028669 | 0.0143 | T | Study 1 | CV169 | 341 | 72 |
| 8 | NC0077750 | 1 | 79.6 | 0 | -0.26601 | T | Study 1 | CV069 | 441 | 73 |
| 8 | NC0077750 | 1 | 79.6 | 0.022451 | 0.015363 | T | Study 1 | CV049 | 441 | 73 |
| 8 | NC0110365 | 1 | 81.9 | 0.000006 | 0.249912 | A | Study 1 | CV160 | 427 | 74 |
| 8 | NC0009449 | 1 | 82 | -- | -- | G | Study 4 | -- | 188 | 75 |
| 9 | NC0033372 | 1 | 82 | -- | -- | C | Study 5 | -- | 239 | 76 |
| 9 | NC0033372 | 1 | 82 | 0.000238 | -0.01522 | C | Study 1 | CV099 | 239 | 76 |
| 9 | NC0033372 | 1 | 82 | 0.030005 | -0.00688 | A | Study 1 | CV089 | 239 | 76 |
| 9 | NC0033372 | 1 | 82 | 0.03887 | -0.01037 | A | Study 1 | CV088 | 239 | 76 |
| 9 | NC0105925 | 1 | 82.1 | -- | -- | G | Study 4 | -- | 269 | 77 |
| 9 | NC0105925 | 1 | 82.1 | 0.000023 | -0.39513 | A | Study 1 | CV088 | 269 | 77 |
| 9 | NC0105925 | 1 | 82.1 | 0.001341 | -0.114 | A | Study 1 | CV101 | 269 | 77 |
| 9 | NC0105925 | 1 | 82.1 | 0.008233 | -0.11485 | G | Study 1 | CV075 | 269 | 77 |

CONT.

| QTL | Marker | Chr | pos | sig | effect | res allele | Mapping Study | Fav. Parent | SNP Position | SEQ ID |
|---|---|---|---|---|---|---|---|---|---|---|
| 9 | NC0105925 | 1 | 82.1 | 0.000856 | -0.02243 | A | Study 1 | CV072 | 269 | 77 |
| 9 | NC0105925 | 1 | 82.1 | 0.009207 | 0.091617 | A | Study 1 | CV126 | 269 | 77 |
| 9 | NC0113462 | 1 | 82.1 | 0.001028 | 0.204388 | A | Study 1 | CV157 | 308 | 78 |
| 9 | NC0148156 | 1 | 83.2 | -- | -- | C | Study 5 | -- | 267 | 79 |
| 9 | NC0148156 | 1 | 83.2 | 0 | -0.38495 | C | Study 1 | CV069 | 267 | 79 |
| 9 | NC0148156 | 1 | 83.2 | 0.000002 | 0.251324 | C | Study 1 | CV069 | 267 | 79 |
| 9 | NC0033533 | 1 | 84.3 | -- | -- | T | Study 4 | -- | 113 | 80 |
| 9 | NC0033533 | 1 | 84.3 | -- | -- | T | Study 5 | -- | 113 | 80 |
| 9 | NC0033533 | 1 | 84.3 | 0.019404 | 0.052907 | T | Study 1 | CV006 | 113 | 80 |
| 9 | NC0033533 | 1 | 84.3 | 0.000218 | -0.09985 | T | Study 1 | CV050 | 113 | 80 |
| 9 | NC0033533 | 1 | 84.3 | 0.000005 | 0.278326 | T | Study 1 | CV073 | 113 | 80 |
| 9 | NC0033533 | 1 | 84.3 | 0.000637 | 0.097206 | T | Study 1 | CV050 | 113 | 80 |
| 9 | NC0033533 | 1 | 84.3 | 0.047392 | 0.00658 | T | Study 1 | CV050 | 113 | 80 |
| 9 | NC0033533 | 1 | 84.3 | 0.047315 | 0.108913 | T | Study 1 | CV164 | 113 | 80 |
| 9 | NC0033533 | 1 | 84.3 | 0.029676 | 0.053936 | T | Study 1 | CV135 | 113 | 80 |
| 9 | NC0033533 | 1 | 84.3 | 0.019668 | -0.00716 | T | Study 1 | CV089 | 113 | 80 |
| 9 | NC0033533 | 1 | 84.3 | 0.01605 | 0.007894 | T | Study 1 | CV102 | 113 | 80 |
| 9 | NC0036506 | 1 | 84.6 | -- | -- | T | Study 4 | -- | 81 | 81 |
| 9 | NC0036506 | 1 | 84.6 | 0.0278 | -0.10872 | T | Study 1 | CV068 | 81 | 81 |
| 9 | NC0036506 | 1 | 84.6 | 0.014213 | 0.094549 | T | Study 1 | CV082 | 81 | 81 |
| 9 | NC0036506 | 1 | 84.6 | 0.012076 | -0.09052 | C | Study 1 | CV041 | 81 | 81 |
| 9 | NC0036506 | 1 | 84.6 | 0.021669 | -0.04158 | C | Study 1 | CV010 | 81 | 81 |
| 9 | NC0036506 | 1 | 84.6 | 0.009981 | -0.01149 | C | Study 1 | CV010 | 81 | 81 |
| 9 | NC0036506 | 1 | 84.6 | 0.015033 | 0.016512 | T | Study 1 | CV144 | 81 | 81 |
| 9 | NC0043559 | 1 | 84.6 | -- | -- | C | Study 4 | -- | 300 | 82 |
| 9 | NC0172493 | 1 | 86.9 | -- | -- | T | Study 5 | -- | 121 | 83 |
| 9 | NC0173465 | 1 | 86.9 | -- | -- | G | Study 5 | -- | 540 | 84 |
| 9 | NC0004287 | 1 | 88.1 | 0.03169 | 0.011529 | C | Study 1 | CV069 | 83 | 85 |
| 9 | NC0173852 | 1 | 88.1 | -- | -- | G | Study 5 | -- | 556 | 86 |
| 10 | NC0111854 | 1 | 91.4 | 0 | -0.41188 | AGT | Study 1 | CV069 | 308 | 87 |
| 10 | NC0111854 | 1 | 91.4 | 0 | -0.50491 | AGT | Study 1 | CV088 | 308 | 87 |
| 10 | NC0111854 | 1 | 91.4 | 0.009565 | 0.01692 | AGT | Study 1 | CV049 | 308 | 87 |
| 10 | NC0111854 | 1 | 91.4 | 0.012466 | 0.135944 | AGT | Study 1 | CV149 | 308 | 87 |

CONT.

| QTL | Marker | Chr | pos | sig | effect | res allele | Mapping Study | Fav. Parent | SNP Position | SEQ ID |
|---|---|---|---|---|---|---|---|---|---|---|
| 10 | NC0111854 | 1 | 91.4 | 0.000014 | -0.56207 | AGT | Study 1 | CV130 | 308 | 87 |
| 10 | NC0111854 | 1 | 91.4 | 0.017078 | 0.012712 | AGT | Study 1 | CV069 | 308 | 87 |
| 10 | NC0111854 | 1 | 91.4 | 0.000345 | 0.023099 | AGT | Study 1 | CV169 | 308 | 87 |
| 10 | NC0035579 | 1 | 94.5 | -- | -- | G | Study 4 | -- | 282 | 88 |
| 10 | NC0035579 | 1 | 94.5 | 0 | -0.29537 | A | Study 1 | CV069 | 282 | 88 |
| 10 | NC0035579 | 1 | 94.5 | 0 | 0.312066 | A | Study 1 | CV069 | 282 | 88 |
| 10 | NC0035579 | 1 | 94.5 | 0.00003 | 0.01724 | A | Study 1 | CV137 | 282 | 88 |
| 10 | NC0035579 | 1 | 94.5 | 0.000018 | 0.338835 | A | Study 1 | CV073 | 282 | 88 |
| 10 | NC0035579 | 1 | 94.5 | 0.003056 | 0.398766 | A | Study 1 | CV167 | 282 | 88 |
| 10 | NC0035579 | 1 | 94.5 | 0.039875 | 0.012223 | A | Study 1 | CV150 | 282 | 88 |
| 10 | NC0035579 | 1 | 94.5 | 0.001468 | 0.019444 | A | Study 1 | CV142 | 282 | 88 |
| 10 | NC0035579 | 1 | 94.5 | 0.000415 | 0.019044 | A | Study 1 | CV142 | 282 | 88 |
| 10 | NC0035579 | 1 | 94.5 | 0.007845 | 0.130402 | G | Study 1 | CV118 | 282 | 88 |
| 10 | NC0019256 | 1 | 96.4 | -- | -- | G | Study 4 | -- | 354 | 89 |
| 10 | NC0025863 | 1 | 96.7 | 0.008478 | 0.15461 | A | Study 1 | CV070 | 107 | 90 |
| 10 | NC0025863 | 1 | 96.7 | 0.001268 | -0.01406 | T | Study 1 | CV105 | 107 | 90 |
| 10 | NC0068281 | 1 | 97.8 | -- | -- | T | Study 4 | -- | 484 | 91 |
| 10 | NC0072083 | 1 | 97.8 | 0.003733 | -0.05 | A | Study 1 | CV010 | 416 | 92 |
| 10 | NC0069524 | 1 | 99.9 | 0.029145 | -0.00653 | G | Study 1 | CV089 | 514 | 93 |
| 10 | NC0016873 | 1 | 101 | 0.028498 | 0.008016 | G | Study 1 | CV102 | 35 | 94 |
| 10 | NC0016873 | 1 | 101 | -- | -- | G | Study 5 | -- | 35 | 94 |
| 11 | NC0015205 | 1 | 101.5 | 0.028009 | 0.01562 | G | Study 1 | CV074 | 401 | 95 |
| 11 | NC0015205 | 1 | 101.5 | 0 | 0.339461 | A | Study 1 | CV073 | 401 | 95 |
| 11 | NC0015205 | 1 | 101.5 | 0.006868 | -0.01831 | A | Study 1 | CV072 | 401 | 95 |
| 11 | NC0015205 | 1 | 101.5 | 0.034269 | 0.012401 | A | Study 1 | CV079 | 401 | 95 |
| 11 | NC0015205 | 1 | 101.5 | 0.013942 | -0.01512 | G | Study 1 | CV065 | 401 | 95 |
| 11 | NC0057735 | 1 | 102.5 | <.0001 | 0.31455 | T | Study 3 | -- | 556 | 96 |
| 11 | NC0057735 | 1 | 102.5 | -- | -- | T | Study 5 | -- | 556 | 96 |
| 11 | NC0011522 | 1 | 103.1 | <.0001 | -0.15577 | A | Study 3 | -- | 250 | 97 |
| 11 | NC0153831 | 1 | 103.5 | <.0001 | 0.653221 | T | Study 3 | -- | 466 | 98 |
| 11 | NC0027375 | 1 | 103.7 | 0.002824 | -0.05336 | A | Study 1 | CV010 | 474 | 99 |
| 11 | NC0027375 | 1 | 103.7 | 0.002289 | -0.01304 | A | Study 1 | CV010 | 474 | 99 |
| 11 | NC0027375 | 1 | 103.7 | 0.013036 | 0.08742 | C | Study 1 | CV126 | 474 | 99 |

CONT.

| QTL | Marker | Chr | pos | sig | effect | res allele | Mapping Study | Fav. Parent | SNP Position | SEQ ID |
|---|---|---|---|---|---|---|---|---|---|---|
| 11 | NC0027375 | 1 | 103.7 | 0.022507 | -0.0996 | A | Study 1 | CV075 | 474 | 99 |
| 11 | NC0028351 | 1 | 103.7 | 0.040047 | -0.00916 | A | Study 1 | CV099 | 475 | 100 |
| 11 | NC0038741 | 1 | 103.7 | <.0001 | -0.32552 | A | Study 3 | -- | 239 | 101 |
| 11 | NC0038741 | 1 | 103.7 | -- | -- | G | Study 4 | -- | 239 | 101 |
| 11 | NC0038741 | 1 | 103.7 | 0.001616 | -0.0843 | G | Study 1 | CV050 | 239 | 101 |
| 11 | NC0038741 | 1 | 103.7 | 0.000001 | 0.14009 | A | Study 1 | CV131 | 239 | 101 |
| 11 | NC0038741 | 1 | 103.7 | 0.010888 | 0.199048 | G | Study 1 | CV132 | 239 | 101 |
| 11 | NC0038741 | 1 | 103.7 | 0.005078 | 0.033261 | G | Study 1 | CV132 | 239 | 101 |
| 11 | NC0038741 | 1 | 103.7 | 0.020662 | 0.285551 | G | Study 1 | CV156 | 239 | 101 |
| 11 | NC0038741 | 1 | 103.7 | 0.00021 | 0.10634 | G | Study 1 | CV050 | 239 | 101 |
| 11 | NC0066981 | 1 | 103.7 | <.0001 | -0.13221 | C | Study 3 | -- | 147 | 102 |
| 11 | NC0066981 | 1 | 103.7 | 0 | -0.51731 | C | Study 1 | CV088 | 147 | 102 |
| 11 | NC0066981 | 1 | 103.7 | 0.003213 | 0.025264 | C | Study 1 | CV162 | 147 | 102 |
| 11 | NC0066981 | 1 | 103.7 | 0.010175 | -0.01374 | C | Study 1 | CV136 | 147 | 102 |
| 11 | NC0200155 | 1 | 103.8 | -- | -- | G | Study 5 | -- | 394 | 103 |
| 11 | NC0005215 | 1 | 104.8 | <.0001 | -0.16825 | A | Study 3 | -- | 495 | 104 |
| 11 | NC0005215 | 1 | 104.8 | -- | -- | T | Study 5 | -- | 495 | 104 |
| 11 | NC0005215 | 1 | 104.8 | 0.041512 | 0.011815 | A | Study 1 | CV159 | 495 | 104 |
| 11 | NC0035117 | 1 | 105.1 | 0.00003 | 0.01814 | G | Study 1 | CV137 | 198 | 105 |
| 11 | NC0035117 | 1 | 105.1 | 0.000009 | 0.266534 | G | Study 1 | CV160 | 198 | 105 |
| 11 | NC0008984 | 1 | 105.5 | -- | -- | T | Study 4 | -- | 376 | 106 |
| 11 | NC0110353 | 1 | 105.5 | 0.000494 | 0.018318 | G | Study 1 | CV142 | 134 | 107 |
| 11 | NC0199546 | 1 | 106 | -- | -- | C | Study 5 | -- | 224 | 108 |
| 11 | NC0155584 | 1 | 106.4 | 0.023636 | 0.013723 | G | Study 1 | CV142 | 190 | 109 |
| 11 | NC0041836 | 1 | 107.7 | -- | -- | * | Study 4 | -- | 92 | 110 |
| 11 | NC0014644 | 1 | 107.8 | 0.002 | -0.11522 | C | Study 3 | -- | 485 | 111 |
| 11 | NC0014644 | 1 | 107.8 | -- | -- | G | Study 5 | -- | 485 | 111 |
| 11 | NC0014644 | 1 | 107.8 | 0.005112 | -0.07254 | C | Study 1 | CV057 | 485 | 111 |
| 11 | NC0014644 | 1 | 107.8 | 0.010697 | 0.153794 | C | Study 1 | CV070 | 485 | 111 |
| 11 | NC0014644 | 1 | 107.8 | 0.000953 | 0.022739 | C | Study 1 | CV169 | 485 | 111 |
| 11 | NC0029829 | 1 | 108 | -- | -- | G | Study 5 | -- | 157 | 112 |
| 11 | NC0107044 | 1 | 108 | 0.032742 | 0.014649 | C | Study 1 | CV144 | 845 | 113 |
| 11 | NC0111828 | 1 | 109.2 | 0 | -0.28348 | C | Study 1 | CV069 | 584 | 114 |

CONT.

| QTL | Marker | Chr | pos | sig | effect | res allele | Mapping Study | Fav. Parent | SNP Position | SEQ ID |
|---|---|---|---|---|---|---|---|---|---|---|
| 11 | NC0111828 | 1 | 109.2 | 0.001346 | 0.016741 | C | Study 1 | CV142 | 584 | 114 |
| 11 | NC0053983 | 1 | 109.4 | -- | -- | T | Study 5 | -- | 471 | 115 |
| 11 | NC0053983 | 1 | 109.4 | 0.035647 | 0.013616 | T | Study 1 | I283669 | 471 | 115 |
| 12 | NC0008901 | 1 | 110.8 | 0 | -0.38107 | T | Study 1 | CV069 | 119 | 116 |
| 12 | NC0008901 | 1 | 110.8 | 0 | 0.301922 | T | Study 1 | CV069 | 119 | 116 |
| 12 | NC0008901 | 1 | 110.8 | 0.000154 | 0.497693 | T | Study 1 | CV167 | 119 | 116 |
| 12 | NC0008901 | 1 | 110.8 | 0.046663 | -0.01351 | T | Study 1 | CV072 | 119 | 116 |
| 12 | NC0143254 | 1 | 110.9 | -- | -- | T | Study 5 | -- | 163 | 117 |
| 12 | NC0080733 | 1 | 111 | 0.003001 | 0.01929 | G | Study 1 | CV049 | 754 | 118 |
| 12 | NC0033728 | 1 | 113.3 | -- | -- | T | Study 4 | -- | 83 | 119 |
| 12 | NC0033728 | 1 | 113.3 | 0.043727 | 0.011941 | C | Study 1 | CV069 | 83 | 119 |
| 12 | NC0029506 | 1 | 113.6 | -- | -- | A | Study 5 | -- | 808 | 120 |
| 12 | NC0002688 | 1 | 114.6 | 0.030028 | -0.01027 | G | Study 1 | CV105 | 69 | 121 |
| 12 | NC0002688 | 1 | 114.6 | 0.000099 | 0.02509 | T | Study 1 | I283669 | 69 | 121 |
| 12 | NC0002688 | 1 | 114.6 | 0.000827 | 0.025773 | C | Study 1 | CV169 | 69 | 121 |
| 12 | NC0004176 | 1 | 116.3 | 0.020065 | 0.005269 | T | Study 1 | CV051 | 61 | 122 |
| 12 | NC0004176 | 1 | 116.3 | 0.001628 | 0.251705 | C | Study 1 | CV073 | 61 | 122 |
| 12 | NC0004176 | 1 | 116.3 | 0.027304 | 0.130251 | C | Study 1 | CV070 | 61 | 122 |
| 12 | NC0050366 | 1 | 118.7 | 0.012475 | 0.183464 | C | Study 1 | CV129 | 306 | 123 |
| 12 | NC0050366 | 1 | 118.7 | 0.017165 | -0.06154 | ************ | Study 1 | CV057 | 306 | 123 |
| 12 | NC0050366 | 1 | 118.7 | 0.009605 | 0.09125 | ************ | Study 1 | CV126 | 306 | 123 |
| 12 | NC0050366 | 1 | 118.7 | 0.029065 | 0.013738 | ************ | Study 1 | CV159 | 306 | 123 |
| 12 | NC0039351 | 1 | 118.8 | -- | -- | G | Study 4 | -- | 678 | 124 |
| 12 | NC0039351 | 1 | 118.8 | 0.001394 | -0.16829 | G | Study 1 | CV068 | 678 | 124 |
| 12 | NC0039351 | 1 | 118.8 | 0.026093 | 0.048373 | A | Study 1 | CV006 | 678 | 124 |
| 12 | NC0143864 | 1 | 118.8 | -- | -- | C | Study 5 | -- | 315 | 125 |
| 12 | NC0146461 | 1 | 118.8 | -- | -- | T | Study 5 | -- | 41 | 126 |
| 13 | NC0107701 | 1 | 121 | 0 | -0.39377 | G | Study 1 | CV069 | 376 | 127 |
| 13 | NC0107701 | 1 | 121 | 0.026794 | 0.012866 | A | Study 1 | CV159 | 376 | 127 |
| 13 | NC0035132 | 1 | 121.5 | 0 | -0.75003 | GAGAG | Study 1 | CV130 | 394 | 128 |
| 13 | NC0036448 | 1 | 124.4 | 0.004105 | -0.12039 | T | Study 1 | CV075 | 167 | 129 |
| 13 | NC0036448 | 1 | 124.4 | 0.013854 | -0.01675 | T | Study 1 | CV072 | 167 | 129 |
| 13 | NC0036448 | 1 | 124.4 | 0.021927 | -0.00704 | C | Study 1 | CV089 | 167 | 129 |

CONT.

| QTL | Marker | Chr | pos | sig | effect | res allele | Mapping Study | Fav. Parent | SNP Position | SEQ ID |
|---|---|---|---|---|---|---|---|---|---|---|
| 13 | NC0034627 | 1 | 126 | 0 | 0.396474 | A | Study 1 | CV073 | 415 | 130 |
| 13 | NC0034627 | 1 | 126 | 0.000852 | 0.197596 | A | Study 1 | CV160 | 415 | 130 |
| 13 | NC0035547 | 1 | 126 | -- | -- | T | Study 4 | -- | 190 | 131 |
| 13 | NC0035547 | 1 | 126 | 0.000037 | -0.39867 | C | Study 1 | CV088 | 190 | 131 |
| 13 | NC0035547 | 1 | 126 | 0.000483 | 0.015284 | C | Study 1 | CV137 | 190 | 131 |
| 13 | NC0035547 | 1 | 126 | 0.000489 | -0.09452 | C | Study 1 | CV050 | 190 | 131 |
| 13 | NC0035547 | 1 | 126 | 0.000052 | 0.168203 | C | Study 1 | CV166 | 190 | 131 |
| 13 | NC0035547 | 1 | 126 | 0.001475 | 0.093098 | C | Study 1 | CV050 | 190 | 131 |
| 13 | NC0035547 | 1 | 126 | 0.040027 | 0.007033 | C | Study 1 | CV050 | 190 | 131 |
| 13 | NC0035547 | 1 | 126 | 0.036943 | 0.123063 | C | Study 1 | CV070 | 190 | 131 |
| 13 | NC0039531 | 1 | 126 | 0.030394 | 0.015354 | G | Study 1 | I283669 | 215 | 132 |
| 13 | NC0039531 | 1 | 126 | 0.039109 | -0.05408 | C | Study 1 | CV052 | 215 | 132 |
| 13 | NC0111780 | 1 | 126.1 | 0.000029 | -0.19976 | A | Study 1 | CV069 | 284 | 133 |
| 13 | NC0028187 | 1 | 127.3 | -- | -- | G | Study 5 | -- | 343 | 134 |
| 14 | NC0040655 | 1 | 128.9 | 0.004351 | -0.018 | A | Study 1 | CV065 | 59 | 135 |
| 14 | NC0107077 | 1 | 130.7 | 0.005469 | -0.00887 | G | Study 1 | I294213 | 380 | 136 |
| 14 | NC0107077 | 1 | 130.7 | 0.006096 | -0.14266 | A | Study 1 | CV068 | 380 | 136 |
| 14 | NC0107077 | 1 | 130.7 | 0.001419 | 0.021099 | A | Study 1 | CV049 | 380 | 136 |
| 14 | NC0107077 | 1 | 130.7 | 0.006381 | 0.160018 | A | Study 1 | CV157 | 380 | 136 |
| 14 | NC0107077 | 1 | 130.7 | 0.013837 | 0.013534 | A | Study 1 | CV007 | 380 | 136 |
| 14 | NC0111987 | 1 | 132.8 | 0.036863 | 0.079081 | T | Study 1 | CV082 | 416 | 137 |
| 14 | NC0111987 | 1 | 132.8 | 0.006906 | -0.01323 | A | Study 1 | CV053 | 416 | 137 |
| 14 | NC0111987 | 1 | 132.8 | 0.003237 | 0.02031 | T | Study 1 | CV169 | 416 | 137 |
| 14 | NC0008719 | 1 | 137.1 | -- | -- | G | Study 5 | -- | 244 | 138 |
| 14 | NC0008719 | 1 | 137.1 | 0.00266 | 0.162115 | G | Study 1 | CV069 | 244 | 138 |
| 14 | NC0008719 | 1 | 137.1 | 0.012024 | 0.328433 | G | Study 1 | CV167 | 244 | 138 |
| 14 | NC0008719 | 1 | 137.1 | 0.001293 | 0.02364 | G | Study 1 | CV169 | 244 | 138 |
| 14 | NC0154883 | 1 | 137.4 | 0.048743 | -0.03626 | C | Study 1 | CV070 | 991 | 139 |
| 14 | NC0154883 | 1 | 137.4 | 0.020375 | 0.13651 | C | Study 1 | CV070 | 991 | 139 |
| 14 | NC0154883 | 1 | 137.4 | 0 | -0.71062 | C | Study 1 | CV130 | 991 | 139 |
| 15 | NC0108100 | 1 | 142.1 | 0.031337 | 0.013987 | GGC | Study 1 | CV159 | 387 | 140 |
| 15 | NC0108100 | 1 | 142.1 | 0.003782 | 0.016631 | GGC | Study 1 | CV159 | 387 | 140 |
| 15 | NC0024096 | 1 | 145.2 | 0.016863 | -0.25053 | G | Study 1 | CV088 | 212 | 141 |

CONT.

| QTL | Marker | Chr | pos | sig | effect | res allele | Mapping Study | Fav. Parent | SNP Position | SEQ ID |
|---|---|---|---|---|---|---|---|---|---|---|
| 15 | NC0024096 | 1 | 145.2 | 0.043688 | -0.00976 | T | Study 1 | CV053 | 212 | 141 |
| 15 | NC0024096 | 1 | 145.2 | 0.035957 | 0.012589 | T | Study 1 | CV013 | 212 | 141 |
| 15 | NC0024096 | 1 | 145.2 | 0.043183 | -0.01385 | G | Study 1 | CV072 | 212 | 141 |
| 15 | NC0155887 | 1 | 145.3 | 0.00504 | 0.098877 | G | Study 1 | CV126 | 49 | 142 |
| 15 | NC0199385 | 1 | 145.3 | -- | -- | T | Study 5 | -- | 160 | 143 |
| 15 | NC0023774 | 1 | 146.1 | 0.001574 | 0.100805 | G | Study 1 | CV131 | 388 | 144 |
| 15 | NC0023774 | 1 | 146.1 | 0 | 0.313511 | G | Study 1 | CV073 | 388 | 144 |
| 15 | NC0023774 | 1 | 146.1 | 0.00035 | -0.14063 | G | Study 1 | CV075 | 388 | 144 |
| 15 | NC0023774 | 1 | 146.1 | 0.004933 | 0.080017 | A | Study 1 | CV050 | 388 | 144 |
| 15 | NC0023774 | 1 | 146.1 | 0.035029 | -0.01769 | A | Study 1 | CV063 | 388 | 144 |
| 15 | NC0147024 | 1 | 153.2 | 0.026141 | -0.00661 | C | Study 1 | CV052 | 770 | 145 |
| 16 | NC0107621 | 1 | 153.5 | 0.026884 | 0.176284 | ******* | Study 1 | CV132 | 366 | 146 |
| 16 | NC0107621 | 1 | 153.5 | 0.015765 | -0.01255 | ******* | Study 1 | CV136 | 366 | 146 |
| 16 | NC0107621 | 1 | 153.5 | 0.000069 | -0.52234 | ******* | Study 1 | CV130 | 366 | 146 |
| 16 | NC0107621 | 1 | 153.5 | 0.039525 | 0.012946 | ******* | Study 1 | CV159 | 366 | 146 |
| 16 | NC0107621 | 1 | 153.5 | 0.002146 | 0.017706 | ******* | Study 1 | CV159 | 366 | 146 |
| 16 | NC0012090 | 1 | 154.5 | 0.000243 | 0.16941 | C | Study 1 | CV166 | 289 | 147 |
| 16 | NC0040338 | 1 | 156.3 | -- | -- | T | Study 4 | -- | 458 | 148 |
| 16 | NC0040338 | 1 | 156.3 | 0.03526 | -0.01234 | T | Study 1 | CV040 | 458 | 148 |
| 16 | NC0038247 | 1 | 157 | -- | -- | G | Study 5 | -- | 267 | 149 |
| 16 | NC0016755 | 1 | 159.7 | 0.025959 | -0.00718 | T | Study 1 | I294213 | 141 | 150 |
| 16 | NC0016755 | 1 | 159.7 | 0.005005 | 0.006356 | C | Study 1 | CV051 | 141 | 150 |
| 16 | NC0016755 | 1 | 159.7 | 0.029313 | 0.172558 | C | Study 1 | CV073 | 141 | 150 |
| 16 | NC0016755 | 1 | 159.7 | 0.010956 | 0.32269 | C | Study 1 | CV167 | 141 | 150 |
| 16 | NC0016755 | 1 | 159.7 | 0.002286 | -0.05528 | C | Study 1 | CV070 | 141 | 150 |
| 16 | NC0016755 | 1 | 159.7 | 0.004065 | -0.0194 | T | Study 1 | CV072 | 141 | 150 |
| 16 | NC0036863 | 1 | 159.8 | 0.0024 | 0.100323 | T | Study 3 | -- | 287 | 151 |
| 16 | NC0036863 | 1 | 159.8 | -- | -- | T | Study 4 | -- | 287 | 151 |
| 16 | NC0036863 | 1 | 159.8 | 0.044448 | -0.00908 | T | Study 1 | CV105 | 287 | 151 |
| 16 | NC0036863 | 1 | 159.8 | 0.017248 | 0.029062 | T | Study 1 | CV154 | 287 | 151 |
| 16 | NC0068400 | 1 | 160.5 | -- | -- | C | Study 5 | -- | 462 | 152 |
| 17 | NC0041280 | 1 | 161.4 | 0.011076 | 0.011001 | C | Study 1 | CV137 | 223 | 153 |
| 17 | NC0050719 | 1 | 161.4 | 0.000301 | -0.13715 | G | Study 1 | CV075 | 136 | 154 |

CONT.

| QTL | Marker | Chr | pos | sig | effect | res allele | Mapping Study | Fav. Parent | SNP Position | SEQ ID |
|---|---|---|---|---|---|---|---|---|---|---|
| 17 | NC0111052 | 1 | 162.2 | 0.004792 | 0.090205 | G | Study 1 | CV131 | 315 | 155 |
| 17 | NC0111052 | 1 | 162.2 | 0.000069 | 0.247737 | G | Study 1 | CV073 | 315 | 155 |
| 17 | NC0111052 | 1 | 162.2 | 0.004221 | 0.022368 | G | Study 1 | CV169 | 315 | 155 |
| 17 | NC0200141 | 1 | 162.2 | -- | -- | G | Study 5 | -- | 743 | 156 |
| 17 | NC0109328 | 1 | 162.9 | 0.008108 | -0.01304 | A | Study 1 | CV053 | 552 | 157 |
| 17 | NC0109328 | 1 | 162.9 | 0.011579 | -0.00813 | A | Study 1 | CV052 | 552 | 157 |
| 17 | NC0109328 | 1 | 162.9 | 0.023268 | 0.012074 | G | Study 1 | CV142 | 552 | 157 |
| 17 | NC0070305 | 1 | 166.5 | -- | -- | T | Study 4 | -- | 532 | 158 |
| 17 | NC0021568 | 1 | 167.1 | 0.02998 | -0.00765 | C | Study 1 | CV080 | 90 | 159 |
| 17 | NC0070702 | 1 | 167.1 | 0.000649 | -0.02101 | C | Study 1 | CV065 | 1001 | 160 |
| 17 | NC0004453 | 1 | 169.3 | 0.040369 | 0.089619 | C | Study 1 | CV093 | 361 | 161 |
| 17 | NC0004453 | 1 | 169.3 | 0.02063 | 0.009746 | C | Study 1 | CV137 | 361 | 161 |
| 17 | NC0004453 | 1 | 169.3 | 0.000171 | 0.157862 | C | Study 1 | CV166 | 361 | 161 |
| 17 | NC0009626 | 1 | 169.6 | -- | -- | G | Study 5 | -- | 236 | 162 |
| 17 | NC0009626 | 1 | 169.6 | 0.039686 | 0.058912 | G | Study 1 | CV128 | 236 | 162 |
| 17 | NC0009626 | 1 | 169.6 | 0.046176 | 0.069951 | C | Study 1 | CV126 | 236 | 162 |
| 17 | NC0009626 | 1 | 169.6 | 0.035248 | 0.022494 | C | Study 1 | CV134 | 236 | 162 |
| 18 | NC0069565 | 1 | 172.1 | 0.010716 | 0.014683 | T | Study 1 | CV159 | 591 | 163 |
| 18 | NC0105648 | 1 | 172.2 | 0.004942 | 0.017025 | C | Study 1 | I283669 | 264 | 164 |
| 18 | NC0105648 | 1 | 172.2 | 0.014637 | -0.01388 | T | Study 1 | I294213 | 264 | 164 |
| 18 | NC0199667 | 1 | 173.1 | -- | -- | T | Study 5 | -- | 212 | 165 |
| 18 | NC0067728 | 1 | 173.7 | -- | -- | C | Study 4 | -- | 218 | 166 |
| 18 | NC0067728 | 1 | 173.7 | 0.015392 | -0.01486 | C | Study 1 | CV065 | 218 | 166 |
| 18 | NC0109882 | 1 | 174.1 | 0.024287 | -0.01719 | C | Study 1 | CV041 | 295 | 167 |
| 18 | NC0109882 | 1 | 174.1 | 0.013074 | -0.01205 | C | Study 1 | CV053 | 295 | 167 |
| 18 | NC0109882 | 1 | 174.1 | 0.011058 | 0.068528 | T | Study 1 | CV168 | 295 | 167 |
| 18 | NC0004981 | 1 | 174.6 | -- | -- | T | Study 4 | -- | 153 | 168 |
| 18 | NC0004981 | 1 | 174.6 | 0.000023 | -0.5592 | T | Study 1 | CV130 | 153 | 168 |
| 18 | NC0069344 | 1 | 176.9 | 0.049895 | -0.00489 | A | Study 1 | CV018 | 206 | 169 |
| 18 | NC0040092 | 1 | 177.3 | -- | -- | G | Study 5 | -- | 327 | 170 |
| 18 | NC0108030 | 1 | 179.2 | -- | -- | T | Study 4 | -- | 95 | 171 |
| 18 | NC0108030 | 1 | 179.2 | 0.021664 | 0.236544 | T | Study 1 | CV109 | 95 | 171 |
| 18 | NC0108030 | 1 | 179.2 | 0.003403 | 0.080668 | C | Study 1 | CV116 | 95 | 171 |

CONT.

| QTL | Marker | Chr | pos | sig | effect | res allele | Mapping Study | Fav. Parent | SNP Position | SEQ ID |
|---|---|---|---|---|---|---|---|---|---|---|
| 18 | NC0108030 | 1 | 179.2 | 0.002547 | 0.269316 | T | Study 1 | CV161 | 95 | 171 |
| 18 | NC0108030 | 1 | 179.2 | 0.025776 | -0.0138 | C | Study 1 | CV093 | 95 | 171 |
| 18 | NC0027567 | 1 | 179.4 | 0.034385 | -0.26596 | G | Study 1 | CV112 | 79 | 172 |
| 18 | NC0027567 | 1 | 179.4 | 0.000191 | -0.08989 | G | Study 1 | I294213 | 79 | 172 |
| 18 | NC0027567 | 1 | 179.4 | 0.023899 | -0.02222 | G | Study 1 | I294213 | 79 | 172 |
| 18 | NC0027567 | 1 | 179.4 | 0.0123 | -0.02083 | C | Study 1 | CV057 | 79 | 172 |
| 19 | NC0016724 | 1 | 180.8 | -- | -- | T | Study 4 | -- | 88 | 173 |
| 19 | NC0016724 | 1 | 180.8 | 0.008725 | 0.338865 | C | Study 1 | CV167 | 88 | 173 |
| 19 | NC0016724 | 1 | 180.8 | 0.045455 | -0.01228 | T | Study 1 | CV065 | 88 | 173 |
| 19 | NC0106296 | 1 | 181 | 0.015245 | -0.14475 | G | Study 1 | CV131 | 178 | 174 |
| 19 | NC0106296 | 1 | 181 | 0.0274 | 0.011628 | G | Study 1 | CV142 | 178 | 174 |
| 19 | NC0004909 | 1 | 182.1 | 0.008957 | -0.0073 | T | Study 1 | CV052 | 324 | 175 |
| 19 | NC0004909 | 1 | 182.1 | 0.047207 | -0.00715 | A | Study 1 | CV080 | 324 | 175 |
| 19 | NC0200153 | 1 | 182.8 | -- | -- | C | Study 5 | -- | 151 | 176 |
| 19 | NC0005098 | 1 | 183.9 | -- | -- | G | Study 5 | -- | 133 | 177 |
| 19 | NC0005098 | 1 | 183.9 | 0.005439 | -0.16305 | A | Study 1 | CV131 | 133 | 177 |
| 19 | NC0005098 | 1 | 183.9 | 0.000408 | -0.02569 | G | Study 1 | CV041 | 133 | 177 |
| 19 | NC0005098 | 1 | 183.9 | 0.039397 | 0.008647 | G | Study 1 | CV137 | 133 | 177 |
| 19 | NC0005098 | 1 | 183.9 | 0.002445 | 0.272181 | G | Study 1 | CV161 | 133 | 177 |
| 19 | NC0005098 | 1 | 183.9 | 0.004851 | 0.016224 | A | Study 1 | CV159 | 133 | 177 |
| 19 | NC0032240 | 1 | 185.3 | 0.000253 | -0.08866 | T | Study 1 | I294213 | 427 | 178 |
| 19 | NC0032240 | 1 | 185.3 | 0.000535 | 0.145473 | A | Study 1 | CV166 | 427 | 178 |
| 19 | NC0032240 | 1 | 185.3 | 0.033345 | -0.01183 | T | Study 1 | I294213 | 427 | 178 |
| 19 | NC0032240 | 1 | 185.3 | 0.015729 | 0.070549 | A | Study 1 | CV150 | 427 | 178 |
| 20 | NC0039502 | 1 | 195.5 | 0.045861 | 0.007052 | G | Study 1 | CV102 | 41 | 179 |
| 20 | NC0039502 | 1 | 195.5 | 0.034518 | -0.01834 | A | Study 1 | CV057 | 41 | 179 |
| 20 | NC0039502 | 1 | 195.5 | 0.034278 | -0.0143 | A | Study 1 | CV083 | 41 | 179 |
| 20 | NC0039502 | 1 | 195.5 | 0.017125 | 0.069632 | G | Study 1 | CV150 | 41 | 179 |
| 20 | NC0111289 | 1 | 195.5 | 0.001864 | -0.02278 | ******** | Study 1 | CV041 | 628 | 180 |
| 20 | NC0111289 | 1 | 195.5 | 0.031502 | 0.023656 | TGATATGC | Study 1 | CV134 | 628 | 180 |
| 20 | NC0015937 | 1 | 197.7 | -- | -- | T | Study 5 | -- | 394 | 181 |
| 20 | NC0008982 | 1 | 198.4 | -- | -- | G | Study 5 | -- | 359 | 182 |
| 20 | NC0008982 | 1 | 198.4 | 0.003123 | -0.01418 | G | Study 1 | CV053 | 359 | 182 |

CONT.

| QTL | Marker | Chr | pos | sig | effect | res allele | Mapping Study | Fav. Parent | SNP Position | SEQ ID |
|---|---|---|---|---|---|---|---|---|---|---|
| 20 | NC0008982 | 1 | 198.4 | 0.001701 | 0.088803 | G | Study 1 | CV116 | 359 | 182 |
| 20 | NC0008982 | 1 | 198.4 | 0.033805 | -0.07295 | G | Study 1 | CV017 | 359 | 182 |
| 20 | NC0008982 | 1 | 198.4 | 0.005741 | -0.00842 | G | Study 1 | CV052 | 359 | 182 |
| 20 | NC0008982 | 1 | 198.4 | 0.007367 | 0.112934 | G | Study 1 | CV166 | 359 | 182 |
| 20 | NC0008982 | 1 | 198.4 | 0.030501 | 0.278564 | G | Study 1 | CV167 | 359 | 182 |
| 20 | NC0008982 | 1 | 198.4 | 0.005452 | 0.016077 | A | Study 1 | CV159 | 359 | 182 |
| 20 | NC0040427 | 1 | 199.4 | 0.0019 | -0.07854 | T | Study 1 | I294213 | 213 | 183 |
| 20 | NC0040427 | 1 | 199.4 | 0.012537 | -0.01562 | T | Study 1 | CV093 | 213 | 183 |
| 21 | NC0113311 | 1 | 201.5 | 0.0007 | 0.116798 | G | Study 3 | -- | 98 | 184 |
| 21 | NC0200182 | 1 | 201.9 | -- | -- | G | Study 5 | -- | 568 | 185 |
| 21 | NC0013584 | 1 | 204.4 | 0.001272 | -0.18981 | C | Study 1 | CV131 | 304 | 186 |
| 21 | NC0013584 | 1 | 204.4 | 0.023005 | 0.047908 | C | Study 1 | CV067 | 304 | 186 |
| 21 | NC0013584 | 1 | 204.4 | 0.000759 | 0.091944 | C | Study 1 | CV116 | 304 | 186 |
| 21 | NC0013584 | 1 | 204.4 | 0.001666 | -0.01037 | C | Study 1 | CV052 | 304 | 186 |
| 21 | NC0013584 | 1 | 204.4 | 0.033867 | 0.062385 | T | Study 1 | CV128 | 304 | 186 |
| 21 | NC0013584 | 1 | 204.4 | 0.024529 | 0.013142 | T | Study 1 | CV159 | 304 | 186 |
| 21 | NC0013584 | 1 | 204.4 | 0.001223 | -0.02312 | T | Study 1 | CV083 | 304 | 186 |
| 21 | NC0111792 | 1 | 205.8 | 0.001994 | 0.137484 | A | Study 1 | CV093 | 244 | 187 |
| 21 | NC0031264 | 1 | 205.9 | 0.000649 | -0.01606 | T | Study 1 | CV053 | 552 | 188 |
| 21 | NC0023209 | 1 | 206.3 | -- | -- | G | Study 5 | -- | 509 | 189 |
| 21 | NC0033995 | 1 | 206.4 | -- | -- | T | Study 5 | -- | 199 | 190 |
| 21 | NC0035961 | 1 | 206.7 | 0.026262 | 0.050164 | T | Study 1 | CV074 | 223 | 191 |
| 21 | NC0035961 | 1 | 206.7 | 0.04561 | 0.058732 | C | Study 1 | CV120 | 223 | 191 |
| 21 | NC0039896 | 1 | 207.6 | -- | -- | C | Study 5 | -- | 648 | 192 |
| 21 | NC0009701 | 1 | 207.9 | 0.001068 | -0.02499 | G | Study 1 | CV041 | 429 | 193 |
| 21 | NC0009701 | 1 | 207.9 | 0.027275 | -0.01135 | G | Study 1 | CV088 | 429 | 193 |
| 21 | NC0009701 | 1 | 207.9 | 0.022402 | -0.01456 | A | Study 1 | CV093 | 429 | 193 |
| 21 | NC0009701 | 1 | 207.9 | 0.022594 | -0.01534 | A | Study 1 | CV113 | 429 | 193 |
| 21 | NC0014038 | 1 | 207.9 | -- | -- | G | Study 5 | -- | 78 | 194 |
| 21 | NC0014038 | 1 | 207.9 | 0.043325 | 0.022897 | G | Study 1 | CV134 | 78 | 194 |
| 21 | NC0016059 | 1 | 207.9 | 0.003762 | -0.0859 | T | Study 1 | CV017 | 239 | 195 |
| 21 | NC0016059 | 1 | 207.9 | 0.039384 | -0.05288 | T | Study 1 | I294213 | 239 | 195 |
| 21 | NC0016059 | 1 | 207.9 | 0.038043 | -0.01094 | G | Study 1 | CV088 | 239 | 195 |

CONT.

| QTL | Marker | Chr | pos | sig | effect | res allele | Mapping Study | Fav. Parent | SNP Position | SEQ ID |
|---|---|---|---|---|---|---|---|---|---|---|
| 21 | NC0039486 | 1 | 207.9 | -- | -- | C | Study 5 | -- | 201 | 196 |
| 21 | NC0039486 | 1 | 207.9 | 0.010733 | -0.34331 | A | Study 1 | CV130 | 201 | 196 |
| 21 | NC0039486 | 1 | 207.9 | 0.004472 | -0.02445 | C | Study 1 | CV057 | 201 | 196 |
| 21 | NC0039486 | 1 | 207.9 | 0.012904 | 0.152002 | A | Study 1 | CV160 | 201 | 196 |
| 21 | NC0188030 | 1 | 207.9 | -- | -- | T | Study 5 | -- | 528 | 197 |
| 22 | NC0009082 | 1 | 212.7 | 0.005805 | -0.14991 | A | Study 1 | CV131 | 388 | 198 |
| 22 | NC0009082 | 1 | 212.7 | 0.046329 | -0.00858 | G | Study 1 | CV095 | 388 | 198 |
| 22 | NC0009082 | 1 | 212.7 | 0.046167 | -0.01054 | G | Study 1 | CV136 | 388 | 198 |
| 22 | NC0173402 | 1 | 217 | -- | -- | G | Study 5 | -- | 94 | 199 |
| 23 | NC0015344 | 1 | 221.1 | 0.0004 | 0.093073 | G | Study 3 | -- | 420 | 200 |
| 23 | NC0015344 | 1 | 221.1 | 0.011482 | -0.01861 | A | Study 1 | CV041 | 420 | 200 |
| 23 | NC0015344 | 1 | 221.1 | 0.006031 | -0.08603 | A | Study 1 | CV017 | 420 | 200 |
| 23 | NC0015344 | 1 | 221.1 | 0.038454 | -0.04919 | A | Study 1 | CV052 | 420 | 200 |
| 23 | NC0015344 | 1 | 221.1 | 0.009329 | -0.00756 | A | Study 1 | CV052 | 420 | 200 |
| 23 | NC0015344 | 1 | 221.1 | 0.010429 | 0.107685 | G | Study 1 | CV166 | 420 | 200 |
| 23 | NC0015344 | 1 | 221.1 | 0.004057 | -0.01829 | A | Study 1 | CV093 | 420 | 200 |
| 23 | NC0015344 | 1 | 221.1 | 0.041054 | -0.01351 | A | Study 1 | CV113 | 420 | 200 |
| 23 | NC0199731 | 1 | 228.1 | -- | -- | T | Study 5 | -- | 91 | 201 |
| 24 | NC0146570 | 1 | 237 | 0.030193 | -0.08207 | T | Study 1 | CV017 | 232 | 202 |
| 24 | NC0146570 | 1 | 237 | 0.031061 | 0.06269 | T | Study 1 | CV120 | 232 | 202 |
| 24 | NC0110139 | 1 | 237.2 | -- | -- | T | Study 4 | -- | 224 | 203 |
| 24 | NC0107440 | 1 | 237.6 | -- | -- | G | Study 5 | -- | 376 | 204 |
| 24 | NC0107440 | 1 | 237.6 | 0.010223 | 0.013607 | C | Study 1 | CV069 | 376 | 204 |
| 24 | NC0008996 | 1 | 238.1 | 0.019093 | 0.007248 | A | Study 1 | CV170 | 230 | 205 |
| 24 | NC0003691 | 1 | 238.5 | 0.001348 | 0.085352 | G | Study 1 | CV116 | 364 | 206 |
| 24 | NC0003691 | 1 | 238.5 | 0.027064 | 0.021808 | G | Study 1 | CV135 | 364 | 206 |
| 25 | NC0013490 | 1 | 240.7 | 0.043432 | -0.00646 | T | Study 1 | I294213 | 482 | 207 |
| 25 | NC0013490 | 1 | 240.7 | 0.019669 | 0.068741 | C | Study 1 | CV128 | 482 | 207 |
| 25 | NC0013490 | 1 | 240.7 | 0.030817 | 0.011039 | T | Study 1 | CV069 | 482 | 207 |
| 25 | NC0030840 | 1 | 245.1 | 0.00152 | 0.154041 | G | Study 1 | CV023 | 413 | 208 |
| 25 | NC0030840 | 1 | 245.1 | 0.013522 | -0.0074 | A | Study 1 | CV089 | 413 | 208 |
| 25 | NC0030840 | 1 | 245.1 | 0.033045 | -0.01363 | A | Study 1 | CV113 | 413 | 208 |
| 26 | NC0003506 | 1 | 253.1 | 0.031762 | 0.010865 | C | Study 1 | CV069 | 321 | 209 |

CONT.

| QTL | Marker | Chr | pos | sig | effect | res allele | Mapping Study | Fav. Parent | SNP Position | SEQ ID |
|---|---|---|---|---|---|---|---|---|---|---|
| 26 | NC0002635 | 1 | 254.8 | 0.01201 | 0.068747 | G | Study 1 | CV116 | 188 | 210 |
| 26 | NC0002635 | 1 | 254.8 | 0.032332 | 0.062706 | G | Study 1 | CV128 | 188 | 210 |
| 26 | NC0002635 | 1 | 254.8 | 0.043003 | -0.01449 | G | Study 1 | CV010 | 188 | 210 |
| 26 | NC0002635 | 1 | 254.8 | 0.010337 | 0.013038 | G | Study 1 | CV069 | 188 | 210 |
| 26 | NC0002635 | 1 | 254.8 | 0.039484 | 0.009954 | G | Study 1 | CV012 | 188 | 210 |
| 26 | NC0002635 | 1 | 254.8 | 0.039484 | 0.009954 | G | Study 1 | CV012 | 188 | 210 |
| 26 | NC0005177 | 1 | 256.5 | 0.007183 | 0.026315 | A | Study 1 | CV135 | 420 | 211 |
| 26 | NC0005177 | 1 | 256.5 | 0.016622 | -0.00647 | T | Study 1 | CV138 | 420 | 211 |
| 27 | NC0196279 | 2 | 0 | -- | -- | T | Study 5 | -- | 333 | 212 |
| 27 | NC0031064 | 2 | 2.9 | 0.021452 | 0.011526 | C | Study 1 | CV006 | 118 | 213 |
| 27 | NC0009867 | 2 | 3.3 | -- | -- | T | Study 4 | -- | 245 | 214 |
| 27 | NC0009867 | 2 | 3.3 | 0.033674 | -0.00723 | T | Study 1 | CV122 | 245 | 214 |
| 27 | NC0009867 | 2 | 3.3 | 0.007895 | 0.195296 | T | Study 1 | CV107 | 245 | 214 |
| 27 | NC0009867 | 2 | 3.3 | 0.044737 | 0.035844 | T | Study 1 | CV054 | 245 | 214 |
| 27 | NC0009867 | 2 | 3.3 | 0.018891 | 0.01357 | T | Study 1 | I283669 | 245 | 214 |
| 27 | NC0009867 | 2 | 3.3 | 0.020274 | -0.08419 | T | Study 1 | CV112 | 245 | 214 |
| 27 | NC0009867 | 2 | 3.3 | 0.016588 | -0.09158 | T | Study 1 | CV075 | 245 | 214 |
| 27 | NC0009867 | 2 | 3.3 | 0.005336 | 0.148463 | A | Study 1 | CV164 | 245 | 214 |
| 27 | NC0009867 | 2 | 3.3 | 0.001774 | -0.02158 | T | Study 1 | CV108 | 245 | 214 |
| 27 | NC0015766 | 2 | 7 | 0.028619 | 0.004206 | G | Study 1 | CV103 | 360 | 215 |
| 27 | NC0015766 | 2 | 7 | 0.002039 | -0.12908 | G | Study 1 | CV040 | 360 | 215 |
| 28 | NC0009766 | 2 | 10.1 | 0.029864 | 0.005402 | T | Study 1 | CV051 | 328 | 216 |
| 28 | NC0009766 | 2 | 10.1 | 0.004843 | -0.0199 | C | Study 1 | CV108 | 328 | 216 |
| 28 | NC0039289 | 2 | 15.2 | 0.019385 | 0.06593 | C | Study 2 | -- | 501 | 217 |
| 28 | NC0143411 | 2 | 15.4 | 0.008652 | 0.155926 | T | Study 1 | CV006 | 401 | 218 |
| 28 | NC0143411 | 2 | 15.4 | 0.004083 | 0.217127 | T | Study 1 | CV107 | 401 | 218 |
| 28 | NC0143411 | 2 | 15.4 | 0.024699 | 0.005554 | C | Study 1 | CV051 | 401 | 218 |
| 28 | NC0143411 | 2 | 15.4 | 0.028559 | 0.017561 | T | Study 1 | CV156 | 401 | 218 |
| 28 | NC0143411 | 2 | 15.4 | 0.001424 | -0.08095 | C | Study 1 | CV057 | 401 | 218 |
| 28 | NC0106352 | 2 | 15.8 | 0.041731 | -0.07369 | G | Study 1 | CV112 | 82 | 219 |
| 28 | NC0106678 | 2 | 18.3 | <.0001 | -0.19456 | C | Study 3 | -- | 309 | 220 |
| 28 | NC0106678 | 2 | 18.3 | 0.043579 | 0.073061 | G | Study 1 | CV082 | 309 | 220 |
| 28 | NC0106678 | 2 | 18.3 | 0.008483 | -0.10153 | G | Study 1 | CV075 | 309 | 220 |

CONT.

| QTL | Marker | Chr | pos | sig | effect | res allele | Mapping Study | Fav. Parent | SNP Position | SEQ ID |
|---|---|---|---|---|---|---|---|---|---|---|
| 28 | NC0106678 | 2 | 18.3 | 0.012514 | -0.12936 | G | Study 1 | CV112 | 309 | 220 |
| 28 | NC0106678 | 2 | 18.3 | 0.006099 | 0.146872 | C | Study 1 | CV164 | 309 | 220 |
| 28 | NC0106678 | 2 | 18.3 | 0.033291 | -0.01773 | C | Study 1 | CV063 | 309 | 220 |
| 28 | NC0082235 | 2 | 19.7 | 0.004634 | 0.207131 | A | Study 1 | CV107 | 503 | 221 |
| 28 | NC0082235 | 2 | 19.7 | 0.005089 | -0.12899 | C | Study 1 | CV067 | 503 | 221 |
| 28 | NC0082235 | 2 | 19.7 | 0.029189 | 0.049392 | C | Study 1 | CV006 | 503 | 221 |
| 28 | NC0082235 | 2 | 19.7 | 0.030377 | -0.00624 | A | Study 1 | CV052 | 503 | 221 |
| 28 | NC0082235 | 2 | 19.7 | 0.006953 | 0.013819 | A | Study 1 | CV081 | 503 | 221 |
| 28 | NC0082235 | 2 | 19.7 | 0.010163 | -0.01443 | A | Study 1 | CV076 | 503 | 221 |
| 28 | NC0082235 | 2 | 19.7 | 0.04735 | -0.01448 | A | Study 1 | CV108 | 503 | 221 |
| 29 | NC0028836 | 2 | 27.1 | 0.001 | -0.15236 | C | Study 3 | -- | 103 | 222 |
| 29 | NC0076912 | 2 | 27.5 | 0.01612 | -0.27869 | C | Study 1 | CV112 | 246 | 223 |
| 29 | NC0002814 | 2 | 27.9 | 0.014699 | 0.140612 | C | Study 1 | CV006 | 92 | 224 |
| 30 | NC0002945 | 2 | 30.7 | <.0001 | -0.20824 | A | Study 3 | -- | 254 | 225 |
| 30 | NC0002945 | 2 | 30.7 | 0.004188 | 0.095382 | A | Study 1 | CV082 | 254 | 225 |
| 30 | NC0002945 | 2 | 30.7 | 0.035832 | -0.00777 | A | Study 1 | CV040 | 254 | 225 |
| 30 | NC0002945 | 2 | 30.7 | 0.031399 | 0.187455 | A | Study 1 | CV127 | 254 | 225 |
| 30 | NC0002945 | 2 | 30.7 | 0.004673 | -0.01882 | A | Study 1 | CV108 | 254 | 225 |
| 30 | NC0016074 | 2 | 30.7 | 0.003589 | 0.014821 | G | Study 2 | CV081 | 385 | 226 |
| 30 | NC0080031 | 2 | 33.1 | 0.044514 | 0.058309 | A | Study 1 | -- | 164 | 227 |
| 30 | NC0080031 | 2 | 33.1 | 0.013246 | 0.019791 | G | Study 1 | CV156 | 164 | 227 |
| 30 | NC0002616 | 2 | 34 | 0.035668 | -0.0122 | T | Study 1 | CV076 | 53 | 228 |
| 30 | NC0050315 | 2 | 34 | 0.013291 | 0.067246 | G | Study 1 | CV084 | 256 | 229 |
| 30 | NC0019127 | 2 | 35.5 | 0.000356 | -0.09258 | A | Study 1 | CV057 | 47 | 230 |
| 30 | NC0009706 | 2 | 35.9 | 0.005056 | -0.11779 | G | Study 1 | CV040 | 269 | 231 |
| 31 | NC0107479 | 2 | 42.3 | 0.003725 | -0.1271 | A | Study 1 | CV067 | 195 | 232 |
| 31 | NC0107479 | 2 | 42.3 | 0.026859 | -0.01764 | G | Study 1 | CV057 | 195 | 232 |
| 31 | NC0107479 | 2 | 42.3 | 0.04725 | -0.01198 | A | Study 1 | CV065 | 195 | 232 |
| 31 | NC0109140 | 2 | 44.8 | 0.002131 | -0.09709 | TAAA | Study 1 | CV017 | 578 | 233 |
| 31 | NC0109140 | 2 | 44.8 | 0.03347 | -0.01219 | TAAA | Study 1 | CV086 | 578 | 233 |
| 31 | NC0109140 | 2 | 44.8 | 0.007635 | 0.025868 | TAAA | Study 1 | CV165 | 578 | 233 |
| 31 | NC0109140 | 2 | 44.8 | 0.039602 | 0.013041 | **** | Study 1 | CV144 | 578 | 233 |
| 31 | NC0048553 | 2 | 46.8 | -- | -- | G | Study 5 | -- | 485 | 234 |

CONT.

| QTL | Marker | Chr | pos | sig | effect | res allele | Mapping Study | Fav. Parent | SNP Position | SEQ ID |
|---|---|---|---|---|---|---|---|---|---|---|
| 31 | NC0048553 | 2 | 46.8 | 0.015722 | 0.139889 | A | Study 1 | CV006 | 485 | 234 |
| 31 | NC0048553 | 2 | 46.8 | 0.022553 | 0.133247 | G | Study 1 | CV023 | 485 | 234 |
| 31 | NC0048553 | 2 | 46.8 | 0.007735 | 0.117134 | A | Study 1 | CV125 | 485 | 234 |
| 31 | NC0048553 | 2 | 46.8 | 0.025805 | 0.010687 | A | Study 1 | CV069 | 485 | 234 |
| 31 | NC0048553 | 2 | 46.8 | 0.024206 | 0.01286 | A | Study 1 | CV006 | 485 | 234 |
| 31 | NC0078243 | 2 | 48.8 | 0.010487 | -0.02209 | G | Study 1 | I294213 | 229 | 235 |
| 31 | NC0078243 | 2 | 48.8 | 0.002546 | 0.024556 | A | Study 1 | CV156 | 229 | 235 |
| 31 | NC0078243 | 2 | 48.8 | 0.042652 | 0.019082 | A | Study 1 | CV062 | 229 | 235 |
| 31 | NC0078243 | 2 | 48.8 | 0.001722 | 0.026446 | A | Study 1 | CV161 | 229 | 235 |
| 31 | NC0013275 | 2 | 49.7 | -- | -- | T | Study 5 | -- | 430 | 236 |
| 31 | NC0013275 | 2 | 49.7 | 0.046749 | 0.004412 | T | Study 1 | CV018 | 430 | 236 |
| 31 | NC0013275 | 2 | 49.7 | 0.026967 | -0.01335 | T | Study 1 | CV065 | 430 | 236 |
| 32 | NC0199346 | 2 | 50.8 | -- | -- | T | Study 5 | -- | 235 | 237 |
| 32 | NC0199643 | 2 | 53.2 | -- | -- | T | Study 5 | -- | 197 | 238 |
| 32 | NC0012259 | 2 | 54 | -- | -- | G | Study 5 | -- | 467 | 239 |
| 32 | NC0002630 | 2 | 54.1 | -- | -- | T | Study 5 | -- | 336 | 240 |
| 32 | NC0194506 | 2 | 54.1 | -- | -- | T | Study 5 | -- | 176 | 241 |
| 32 | NC0199954 | 2 | 54.1 | -- | -- | G | Study 5 | -- | 741 | 242 |
| 32 | NC0011181 | 2 | 57.2 | -- | -- | T | Study 5 | -- | 234 | 243 |
| 33 | NC0020105 | 2 | 64.6 | 0.015052 | -0.07658 | A | Study 1 | CV017 | 55 | 244 |
| 33 | NC0020105 | 2 | 64.6 | 0.014794 | 0.024133 | A | Study 1 | CV062 | 55 | 244 |
| 33 | NC0020105 | 2 | 64.6 | 0.000047 | -0.03103 | G | Study 1 | CV083 | 55 | 244 |
| 33 | NC0106391 | 2 | 65.8 | -- | -- | C | Study 5 | -- | 120 | 245 |
| 33 | NC0106391 | 2 | 65.8 | 0.001538 | 0.196545 | A | Study 1 | CV023 | 120 | 245 |
| 33 | NC0106391 | 2 | 65.8 | 0.01248 | 0.019558 | C | Study 1 | CV165 | 120 | 245 |
| 33 | NC0106391 | 2 | 65.8 | 0.017695 | 0.103837 | C | Study 1 | CV125 | 120 | 245 |
| 33 | NC0106391 | 2 | 65.8 | 0.030596 | -0.30557 | C | Study 1 | CV130 | 120 | 245 |
| 33 | NC0002812 | 2 | 65.9 | 0.027142 | -0.01178 | T | Study 1 | CV086 | 417 | 246 |
| 33 | NC0080704 | 2 | 68.5 | 0.033064 | -0.10311 | T | Study 1 | CV067 | 102 | 247 |
| 33 | NC0080704 | 2 | 68.5 | 0.04268 | -0.01322 | C | Study 1 | I294213 | 102 | 247 |
| 33 | NC0080705 | 2 | 68.5 | 0.022866 | -0.00839 | G | Study 1 | CV122 | 281 | 248 |
| 33 | NC0080705 | 2 | 68.5 | 0.009662 | 0.014631 | G | Study 1 | CV150 | 281 | 248 |
| 33 | NC0080705 | 2 | 68.5 | 0.027917 | 0.053641 | G | Study 1 | CV082 | 281 | 248 |

CONT.

| QTL | Marker | Chr | pos | sig | effect | res allele | Mapping Study | Fav. Parent | SNP Position | SEQ ID |
|---|---|---|---|---|---|---|---|---|---|---|
| 33 | NC0080705 | 2 | 68.5 | 0.041536 | 0.036595 | G | Study 1 | CV100 | 281 | 248 |
| 33 | NC0080705 | 2 | 68.5 | 0.042112 | -0.11905 | C | Study 1 | I294213 | 281 | 248 |
| 33 | NC0080705 | 2 | 68.5 | 0.010925 | 0.202826 | G | Study 1 | CV132 | 281 | 248 |
| 33 | NC0080705 | 2 | 68.5 | 0.009512 | 0.308073 | G | Study 1 | CV156 | 281 | 248 |
| 33 | NC0080705 | 2 | 68.5 | 0.000103 | 0.0862 | G | Study 1 | CV074 | 281 | 248 |
| 33 | NC0080705 | 2 | 68.5 | 0.005951 | 0.019505 | G | Study 1 | CV074 | 281 | 248 |
| 33 | NC0080705 | 2 | 68.5 | 0.009807 | 0.02156 | G | Study 1 | CV161 | 281 | 248 |
| 33 | NC0080705 | 2 | 68.5 | 0.017048 | 0.017012 | G | Study 1 | CV150 | 281 | 248 |
| 33 | NC0080705 | 2 | 68.5 | 0.023501 | -0.02693 | C | Study 1 | CV025 | 281 | 248 |
| 33 | NC0080705 | 2 | 68.5 | 0.029172 | 0.035154 | C | Study 1 | CV066 | 281 | 248 |
| 33 | NC0080705 | 2 | 68.5 | 0.001541 | 0.10332 | G | Study 1 | CV150 | 281 | 248 |
| 33 | NC0080705 | 2 | 68.5 | 0.006455 | 0.015434 | C | Study 1 | CV006 | 281 | 248 |
| 34 | NC0009364 | 2 | 71.6 | 0.023181 | -0.1283 | C | Study 1 | I294213 | 410 | 249 |
| 34 | NC0009364 | 2 | 71.6 | 0.043975 | 0.124209 | C | Study 1 | CV159 | 410 | 249 |
| 34 | NC0009364 | 2 | 71.6 | 0.007523 | -0.08545 | C | Study 1 | CV064 | 410 | 249 |
| 34 | NC0009364 | 2 | 71.6 | 0.034367 | -0.01249 | C | Study 1 | I294213 | 410 | 249 |
| 34 | NC0009364 | 2 | 71.6 | 0.000518 | 0.033679 | C | Study 1 | CV165 | 410 | 249 |
| 34 | NC0032200 | 2 | 71.6 | 0.000539 | 0.211843 | C | Study 1 | CV006 | 318 | 250 |
| 34 | NC0032200 | 2 | 71.6 | 0.000019 | -0.11059 | G | Study 1 | CV057 | 318 | 250 |
| 34 | NC0032200 | 2 | 71.6 | 0.017271 | -0.02113 | G | Study 1 | CV057 | 318 | 250 |
| 34 | NC0199855 | 2 | 73.4 |  |  | G | Study 5 | - | 140 | 251 |
| 34 | NC0004697 | 2 | 74.8 | 0.027929 | -0.07205 | G | Study 1 | CV017 | 175 | 252 |
| 34 | NC0004697 | 2 | 74.8 | 0.006438 | 0.069553 | G | Study 1 | CV082 | 175 | 252 |
| 34 | NC0004697 | 2 | 74.8 | 0.041907 | 0.150178 | G | Study 1 | CV129 | 175 | 252 |
| 34 | NC0004697 | 2 | 74.8 | 0.038097 | -0.00547 | A | Study 1 | CV097 | 175 | 252 |
| 34 | NC0004697 | 2 | 74.8 | 0.016885 | 0.018692 | A | Study 1 | CV165 | 175 | 252 |
| 34 | NC0004697 | 2 | 74.8 | 0.026335 | 0.152297 | A | Study 1 | CV144 | 175 | 252 |
| 34 | NC0004697 | 2 | 74.8 | 0.000142 | -0.01814 | G | Study 1 | CV082 | 175 | 252 |
| 34 | NC0104946 | 2 | 74.8 | 0.003939 | -0.13755 | T | Study 1 | CV069 | 269 | 253 |
| 34 | NC0199310 | 2 | 75.7 |  |  | C | Study 5 | - | 246 | 254 |
| 34 | NC0009623 | 2 | 77 | 0.017871 | 0.01142 | C | Study 1 | CV069 | 73 | 255 |
| 34 | NC0042242 | 2 | 77 | 0.025849 | 0.003257 | T | Study 1 | CV006 | 75 | 256 |
| 34 | NC0042242 | 2 | 77 | 0.025849 | 0.003257 | T | Study 1 | CV006 | 75 | 256 |

CONT.

| QTL | Marker | Chr | pos | sig | effect | res allele | Mapping Study | Fav. Parent | SNP Position | SEQ ID |
|---|---|---|---|---|---|---|---|---|---|---|
| 34 | NC0042242 | 2 | 77 | 0.011841 | -0.0584 | C | Study 1 | CV022 | 75 | 256 |
| 34 | NC0042242 | 2 | 77 | 0.03767 | -0.01099 | C | Study 1 | CV086 | 75 | 256 |
| 34 | NC0042242 | 2 | 77 | 0.046478 | 0.111267 | T | Study 1 | CV164 | 75 | 256 |
| 34 | NC0042242 | 2 | 77 | 0.01429 | 0.008867 | T | Study 1 | CV164 | 75 | 256 |
| 34 | NC0042242 | 2 | 77 | 0.045586 | 0.002897 | T | Study 1 | CV006 | 75 | 256 |
| 34 | NC0042242 | 2 | 77 | 0.045586 | 0.002897 | T | Study 1 | CV006 | 75 | 256 |
| 34 | NC0042242 | 2 | 77 | 0.020718 | 0.013547 | T | Study 1 | CV006 | 75 | 256 |
| 34 | NC0015022 | 2 | 77.3 | -- | -- | G | Study 4 | -- | 143 | 257 |
| 34 | NC0015022 | 2 | 77.3 | 0.016103 | 0.013856 | G | Study 1 | CV150 | 143 | 257 |
| 34 | NC0015022 | 2 | 77.3 | 0.017635 | 0.238655 | G | Study 1 | CV109 | 143 | 257 |
| 34 | NC0199362 | 2 | 77.4 | -- | -- | T | Study 5 | -- | 202 | 258 |
| 34 | NC0111617 | 2 | 78.2 | -- | -- | T | Study 4 | -- | 149 | 259 |
| 34 | NC0111617 | 2 | 78.2 | 0.032017 | -0.00786 | T | Study 1 | CV080 | 149 | 259 |
| 34 | NC0111617 | 2 | 78.2 | 0.000727 | -0.15821 | A | Study 1 | I294213 | 149 | 259 |
| 34 | NC0111617 | 2 | 78.2 | 0 | 0.398815 | T | Study 1 | CV157 | 149 | 259 |
| 34 | NC0111617 | 2 | 78.2 | 0.001079 | -0.02033 | A | Study 1 | I294213 | 149 | 259 |
| 34 | NC0035381 | 2 | 79.6 | 0.009025 | 0.008725 | T | Study 1 | CV050 | 80 | 260 |
| 34 | NC0035381 | 2 | 79.6 | 0.000021 | 0.095314 | T | Study 1 | CV074 | 80 | 260 |
| 34 | NC0035381 | 2 | 79.6 | 0.001568 | 0.022668 | T | Study 1 | CV074 | 80 | 260 |
| 34 | NC0035381 | 2 | 79.6 | 0.00002 | -0.10971 | T | Study 1 | CV057 | 80 | 260 |
| 34 | NC0035381 | 2 | 79.6 | 0.010409 | -0.01653 | A | Study 1 | I294213 | 80 | 260 |
| 35 | NC0016297 | 2 | 85 | -- | -- | G | Study 5 | -- | 67 | 261 |
| 35 | NC0016297 | 2 | 85 | 0.000426 | 0.421198 | A | Study 1 | CV156 | 67 | 261 |
| 35 | NC0016297 | 2 | 85 | 0.015823 | 0.038487 | A | Study 1 | CV066 | 67 | 261 |
| 35 | NC0016297 | 2 | 85 | 0.007679 | 0.077492 | A | Study 1 | CV150 | 67 | 261 |
| 35 | NC0016297 | 2 | 85 | 0.00088 | 0.108366 | A | Study 1 | CV150 | 67 | 261 |
| 35 | NC0199396 | 2 | 86.1 | -- | -- | G | Study 5 | -- | 480 | 262 |
| 35 | NC0011466 | 2 | 86.2 | -- | -- | T | Study 4 | -- | 214 | 263 |
| 35 | NC0049430 | 2 | 87.7 | 0.028712 | 0.016071 | T | Study 1 | CV048 | 353 | 264 |
| 35 | NC0049430 | 2 | 87.7 | 0.03503 | 0.009274 | C | Study 1 | CV012 | 353 | 264 |
| 35 | NC0105002 | 2 | 88.6 | -- | -- | T | Study 4 | -- | 167 | 265 |
| 35 | NC0105002 | 2 | 88.6 | 0.01679 | 0.20542 | C | Study 1 | CV132 | 167 | 265 |
| 35 | NC0108493 | 2 | 88.6 | 0.000113 | 0.018603 | A | Study 1 | CV082 | 304 | 266 |

CONT.

| QTL | Marker | Chr | pos | sig | effect | res allele | Mapping Study | Fav. Parent | SNP Position | SEQ ID |
|---|---|---|---|---|---|---|---|---|---|---|
| 35 | NC0108493 | 2 | 88.6 | 0.014271 | -0.11131 | A | Study 1 | CV067 | 304 | 266 |
| 35 | NC0108493 | 2 | 88.6 | 0.000017 | -0.03103 | G | Study 1 | CV083 | 304 | 266 |
| 35 | NC0146518 | 2 | 89.4 | 0.010041 | -0.08236 | G | Study 1 | CV017 | 97 | 267 |
| 35 | NC0146518 | 2 | 89.4 | 0.034037 | 0.003199 | G | Study 1 | CV006 | 97 | 267 |
| 35 | NC0146518 | 2 | 89.4 | 0.034037 | 0.003199 | G | Study 1 | CV006 | 97 | 267 |
| 35 | NC0104479 | 2 | 89.6 | 0.038531 | -0.11475 | T | Study 1 | I294213 | 303 | 268 |
| 35 | NC0104479 | 2 | 89.6 | 0.009926 | 0.333359 | T | Study 1 | CV167 | 303 | 268 |
| 35 | NC0104479 | 2 | 89.6 | 0.03815 | 0.010826 | T | Study 1 | CV013 | 303 | 268 |
| 35 | NC0199564 | 2 | 89.9 | -- | -- | T | Study 5 | -- | 129 | 269 |
| 36 | NC0002805 | 2 | 93.1 | -- | -- | G | Study 5 | -- | 332 | 270 |
| 36 | NC0053463 | 2 | 93.1 | 0.000084 | -0.10365 | G | Study 4 | CV057 | 461 | 271 |
| 36 | NC0053463 | 2 | 93.1 | 0.016684 | 0.106488 | T | Study 1 | CV116 | 461 | 271 |
| 36 | NC0027319 | 2 | 93.2 | -- | -- | G | Study 4 | -- | 54 | 272 |
| 36 | NC0021092 | 2 | 93.4 | 0.00047 | 0.085335 | G | Study 1 | CV082 | 94 | 273 |
| 36 | NC0021092 | 2 | 93.4 | 0.015668 | 0.007299 | G | Study 1 | CV082 | 94 | 273 |
| 36 | NC0021092 | 2 | 93.4 | 0.038395 | -0.00528 | G | Study 1 | CV097 | 94 | 273 |
| 36 | NC0021092 | 2 | 93.4 | 0.012161 | -0.00499 | G | Study 1 | CV100 | 94 | 273 |
| 36 | NC0057604 | 2 | 94 | -- | -- | **** | Study 4 | -- | 412 | 274 |
| 36 | NC0057604 | 2 | 94 | 0.016334 | 0.132169 | CAGG | Study 1 | CV164 | 412 | 274 |
| 36 | NC0057604 | 2 | 94 | 0.004342 | 0.010333 | CAGG | Study 1 | CV164 | 412 | 274 |
| 36 | NC0170324 | 2 | 94 | -- | -- | G | Study 5 | -- | 228 | 275 |
| 36 | NC0172302 | 2 | 94 | 0.000064 | 0.103638 | G | Study 1 | CV168 | 155 | 276 |
| 36 | NC0005467 | 2 | 94.3 | -- | -- | T | Study 4 | -- | 72 | 277 |
| 36 | NC0105696 | 2 | 94.3 | 0.016869 | -0.01055 | C | Study 1 | I294213 | 149 | 278 |
| 36 | NC0105696 | 2 | 94.3 | 0.019211 | 0.007993 | T | Study 1 | CV050 | 149 | 278 |
| 36 | NC0105696 | 2 | 94.3 | 0.024072 | 0.01775 | C | Study 1 | CV165 | 149 | 278 |
| 36 | NC0105696 | 2 | 94.3 | 0.006746 | -0.08421 | C | Study 1 | CV064 | 149 | 278 |
| 36 | NC0105696 | 2 | 94.3 | 0.000364 | -0.01542 | T | Study 1 | CV082 | 149 | 278 |
| 36 | NC0146130 | 2 | 94.6 | -- | -- | G | Study 4 | -- | 96 | 279 |
| 36 | NC0146130 | 2 | 94.6 | -- | -- | G | Study 5 | -- | 96 | 279 |
| 36 | NC0146130 | 2 | 94.6 | 0.000752 | 0.206777 | G | Study 1 | CV006 | 96 | 279 |

CONT.

| QTL | Marker | Chr | pos | sig | effect | res allele | Mapping Study | Fav. Parent | SNP Position | SEQ ID |
|---|---|---|---|---|---|---|---|---|---|---|
| 36 | NC0019874 | 2 | 94.7 | 0.002366 | 0.014364 | A | Study 1 | CV082 | 374 | 280 |
| 36 | NC0023442 | 2 | 94.9 | 0 | 0.424199 | C | Study 1 | CV157 | 354 | 281 |
| 36 | NC0032601 | 2 | 94.9 | 0.019734 | 0.043601 | C | Study 1 | CV100 | 144 | 282 |
| 36 | NC0032601 | 2 | 94.9 | 0.035387 | -0.02475 | C | Study 1 | CV025 | 144 | 282 |
| 36 | NC0173589 | 2 | 95.4 | -- | -- | G | Study 5 | -- | 1001 | 283 |
| 36 | NC0013347 | 2 | 96 | 0.028962 | 0.096917 | A | Study 1 | CV116 | 279 | 284 |
| 36 | NC0079826 | 2 | 96 | 0.00582 | 0.030774 | T | Study 1 | CV165 | 364 | 285 |
| 36 | NC0079826 | 2 | 96 | 0.000045 | 0.039125 | T | Study 1 | CV165 | 364 | 285 |
| 36 | NC0060879 | 2 | 97.7 | -- | -- | G | Study 4 | -- | 363 | 286 |
| 36 | NC0060879 | 2 | 97.7 | 0.007365 | 0.019917 | G | Study 1 | CV048 | 363 | 286 |
| 36 | NC0060879 | 2 | 97.7 | 0.017321 | -0.11688 | G | Study 1 | CV069 | 363 | 286 |
| 36 | NC0108305 | 2 | 97.9 | -- | -- | G | Study 4 | -- | 174 | 287 |
| 36 | NC0108305 | 2 | 97.9 | 0.021372 | 0.141804 | G | Study 1 | CV159 | 174 | 287 |
| 36 | NC0000066 | 2 | 98.3 | 0.032098 | -0.18014 | A | Study 1 | CV044 | 112 | 288 |
| 36 | NC0107911 | 2 | 99.2 | 0.015021 | 0.196344 | T | Study 1 | CV073 | 384 | 289 |
| 36 | NC0107948 | 2 | 99.2 | 0.000016 | 0.094476 | G | Study 1 | CV074 | 274 | 290 |
| 36 | NC0107948 | 2 | 99.2 | 0.000392 | 0.024864 | G | Study 1 | CV074 | 274 | 290 |
| 36 | NC0200140 | 2 | 99.3 | -- | -- | G | Study 5 | -- | 185 | 291 |
| 37 | NC0106407 | 2 | 101.3 | 0.001063 | -0.02421 | A | Study 1 | CV083 | 45 | 292 |
| 37 | NC0106407 | 2 | 101.3 | 0.000254 | -0.01638 | G | Study 1 | CV082 | 45 | 292 |
| 37 | NC0112226 | 2 | 101.5 | 0.013136 | 0.073356 | A | Study 1 | CV128 | 237 | 293 |
| 37 | NC0108607 | 2 | 102.1 | -- | -- | C | Study 4 | -- | 562 | 294 |
| 37 | NC0108607 | 2 | 102.1 | 0.00878 | 0.112684 | A | Study 1 | CV116 | 562 | 294 |
| 37 | NC0153941 | 2 | 102.1 | 0.013789 | 0.065078 | CTT | Study 1 | CV082 | 1176 | 295 |
| 37 | NC0153941 | 2 | 102.1 | 0.003334 | 0.354352 | *** | Study 1 | CV156 | 1176 | 295 |
| 37 | NC0153941 | 2 | 102.1 | 0.010543 | 0.00397 | CTT | Study 1 | CV006 | 1176 | 295 |
| 37 | NC0153941 | 2 | 102.1 | 0.010543 | 0.00397 | CTT | Study 1 | CV006 | 1176 | 295 |
| 37 | NC0153941 | 2 | 102.1 | 0.007161 | 0.079023 | *** | Study 1 | CV150 | 1176 | 295 |
| 37 | NC0153941 | 2 | 102.1 | 0.001598 | 0.104458 | *** | Study 1 | CV150 | 1176 | 295 |
| 37 | NC0053097 | 2 | 102.6 | -- | -- | T | Study 4 | -- | 335 | 296 |
| 37 | NC0053097 | 2 | 102.6 | 0.001765 | 0.083489 | A | Study 1 | CV168 | 335 | 296 |
| 37 | NC0053097 | 2 | 102.6 | 0.000926 | -0.15897 | A | Study 1 | 1294213 | 335 | 296 |
| 37 | NC0053097 | 2 | 102.6 | 0.028115 | -0.02571 | T | Study 1 | CV025 | 335 | 296 |

CONT.

| QTL | Marker | Chr | pos | sig | effect | res allele | Mapping Study | Fav. Parent | SNP Position | SEQ ID |
|---|---|---|---|---|---|---|---|---|---|---|
| 37 | NC0053097 | 2 | 102.6 | 0.009322 | 0.041372 | A | Study 1 | CV066 | 335 | 296 |
| 37 | NC0053097 | 2 | 102.6 | 0.000335 | -0.09311 | A | Study 1 | CV057 | 335 | 296 |
| 37 | NC0053097 | 2 | 102.6 | 0.000568 | -0.01961 | A | Study 1 | I294213 | 335 | 296 |
| 37 | NC0053097 | 2 | 102.6 | 0.047188 | -0.01147 | T | Study 1 | CV093 | 335 | 296 |
| 37 | NC0000551 | 2 | 103.6 | 0.012721 | -0.13777 | T | Study 1 | I294213 | 175 | 297 |
| 37 | NC0000551 | 2 | 103.6 | 0.03013 | 0.03816 | G | Study 1 | CV054 | 175 | 297 |
| 37 | NC0059782 | 2 | 103.9 | -- | -- | C | Study 4 | -- | 167 | 298 |
| 37 | NC0059782 | 2 | 103.9 | 0.041761 | 0.007984 | A | Study 1 | CV101 | 167 | 298 |
| 37 | NC0059782 | 2 | 103.9 | 0.006222 | 0.007092 | A | Study 1 | CV101 | 167 | 298 |
| 37 | NC0059782 | 2 | 103.9 | 0.01123 | 0.183121 | A | Study 1 | CV129 | 167 | 298 |
| 37 | NC0059782 | 2 | 103.9 | 0.045448 | 0.25546 | A | Study 1 | CV167 | 167 | 298 |
| 37 | NC0057210 | 2 | 104.1 | 0.008227 | 0.019356 | T | Study 1 | CV048 | 191 | 299 |
| 37 | NC0057210 | 2 | 104.1 | 0.003364 | 0.01417 | C | Study 1 | CV082 | 191 | 299 |
| 37 | NC0057210 | 2 | 104.1 | 0.014946 | 0.01924 | C | Study 1 | CV165 | 191 | 299 |
| 37 | NC0057210 | 2 | 104.1 | 0 | 0.379191 | C | Study 1 | CV157 | 191 | 299 |
| 37 | NC0020609 | 2 | 104.6 | 0.045185 | 0.012025 | C | Study 1 | CV159 | 292 | 300 |
| 37 | NC0000366 | 2 | 104.9 | <.0001 | 0.169619 | G | Study 3 | -- | 146 | 301 |
| 37 | NC0000366 | 2 | 104.9 | 0.011996 | -0.00522 | G | Study 1 | CV100 | 146 | 301 |
| 37 | NC0084829 | 2 | 104.9 | -- | -- | G | Study 5 | -- | 500 | 302 |
| 37 | NC0151288 | 2 | 107.6 | 0.007687 | -0.00568 | G | Study 1 | CV043 | 1001 | 303 |
| 37 | NC0151288 | 2 | 107.6 | 0.019854 | -0.01432 | G | Study 1 | CV060 | 1001 | 303 |
| 37 | NC0151288 | 2 | 107.6 | 0.021757 | 0.00603 | G | Study 1 | CV101 | 1001 | 303 |
| 37 | NC0151288 | 2 | 107.6 | 0.007549 | 0.020018 | G | Study 1 | CV150 | 1001 | 303 |
| 37 | NC0151288 | 2 | 107.6 | 0.000048 | -0.02332 | A | Study 1 | I294213 | 1001 | 303 |
| 37 | NC0151288 | 2 | 107.6 | 0.000825 | 0.008969 | T | Study 1 | CV024 | 1001 | 303 |
| 38 | NC0082458 | 2 | 112.4 | -- | -- | T | Study 5 | -- | 369 | 304 |
| 38 | NC0082458 | 2 | 112.4 | 0.000964 | 0.014795 | G | Study 1 | CV012 | 369 | 304 |
| 38 | NC0082458 | 2 | 112.4 | 0.001684 | -0.1008 | G | Study 1 | CV017 | 369 | 304 |
| 38 | NC0082458 | 2 | 112.4 | 0.000001 | 0.282159 | G | Study 1 | CV157 | 369 | 304 |
| 38 | NC0082458 | 2 | 112.4 | 0.041351 | 0.023271 | C | Study 1 | CV134 | 369 | 304 |
| 38 | NC0031289 | 2 | 114.8 | 0.002026 | 0.080529 | C | Study 1 | CV168 | 451 | 305 |
| 38 | NC0031289 | 2 | 114.8 | 0.030818 | -0.11415 | C | Study 1 | I294213 | 451 | 305 |
| 38 | NC0031289 | 2 | 114.8 | 0.000286 | -0.02165 | C | Study 1 | I294213 | 451 | 305 |

CONT.

| QTL | Marker | Chr | pos | sig | effect | res allele | Mapping Study | Fav. Parent | SNP Position | SEQ ID |
|---|---|---|---|---|---|---|---|---|---|---|
| 38 | NC0108013 | 2 | 115.3 | 0.009668 | 0.019444 | C | Study 1 | CV048 | 340 | 306 |
| 38 | NC0108013 | 2 | 115.3 | 0.000089 | -0.19014 | T | Study 1 | I294213 | 340 | 306 |
| 38 | NC0108013 | 2 | 115.3 | 0.003751 | 0.179212 | C | Study 1 | CV159 | 340 | 306 |
| 38 | NC0108013 | 2 | 115.3 | 0.003346 | 0.234788 | C | Study 1 | CV073 | 340 | 306 |
| 38 | NC0108013 | 2 | 115.3 | 0.001293 | -0.27283 | T | Study 1 | CV044 | 340 | 306 |
| 38 | NC0111247 | 2 | 115.7 | -- | -- | T | Study 5 | -- | 352 | 307 |
| 38 | NC0111475 | 2 | 115.7 | 0.006351 | 0.214864 | G | Study 1 | CV132 | 283 | 308 |
| 38 | NC0111475 | 2 | 115.7 | 0.045428 | 0.144418 | G | Study 1 | CV129 | 283 | 308 |
| 38 | NC0111475 | 2 | 115.7 | 0.024183 | -0.01 | A | Study 1 | CV082 | 283 | 308 |
| 38 | NC0044080 | 2 | 116.7 | -- | -- | T | Study 5 | -- | 414 | 309 |
| 38 | NC0035094 | 2 | 116.9 | -- | -- | G | Study 5 | -- | 173 | 310 |
| 38 | NC0022775 | 2 | 118.1 | 0.000005 | 0.270715 | G | Study 1 | CV006 | 517 | 311 |
| 38 | NC0022775 | 2 | 118.1 | 0.016671 | 0.006679 | G | Study 1 | CV141 | 517 | 311 |
| 38 | NC0022775 | 2 | 118.1 | 0.021253 | 0.010334 | G | Study 1 | CV142 | 517 | 311 |
| 38 | NC0022775 | 2 | 118.1 | 0.000032 | 0.111798 | A | Study 1 | CV168 | 517 | 311 |
| 38 | NC0022775 | 2 | 118.1 | 0.015622 | -0.12739 | A | Study 1 | I294213 | 517 | 311 |
| 38 | NC0022775 | 2 | 118.1 | 0.042109 | 0.058679 | G | Study 1 | CV050 | 517 | 311 |
| 38 | NC0022775 | 2 | 118.1 | 0.004502 | 0.009419 | G | Study 1 | CV050 | 517 | 311 |
| 38 | NC0022775 | 2 | 118.1 | 0.000907 | -0.18206 | A | Study 1 | CV119 | 517 | 311 |
| 38 | NC0022775 | 2 | 118.1 | 0.016953 | -0.01538 | A | Study 1 | I294213 | 517 | 311 |
| 38 | NC0022775 | 2 | 118.1 | 0.004862 | 0.007812 | G | Study 1 | CV024 | 517 | 311 |
| 38 | NC0022775 | 2 | 118.1 | 0.000594 | -0.01982 | A | Study 1 | I294213 | 517 | 311 |
| 38 | NC0022775 | 2 | 118.1 | 0.000093 | 0.021904 | G | Study 1 | CV006 | 517 | 311 |
| 39 | NC0104954 | 2 | 120.4 | 0.030308 | 0.06209 | G | Study 2 | -- | 376 | 312 |
| 39 | NC0104954 | 2 | 120.4 | 0.01433 | 0.011419 | T | Study 1 | CV170 | 376 | 312 |
| 39 | NC0104954 | 2 | 120.4 | 0.000222 | 0.015936 | T | Study 1 | CV012 | 376 | 312 |
| 39 | NC0104954 | 2 | 120.4 | 0.001632 | 0.249021 | G | Study 1 | CV132 | 376 | 312 |
| 39 | NC0104954 | 2 | 120.4 | 0.003886 | 0.044662 | G | Study 1 | CV066 | 376 | 312 |
| 39 | NC0104954 | 2 | 120.4 | 0.021203 | -0.0158 | T | Study 1 | CV083 | 376 | 312 |
| 39 | NC0151441 | 2 | 120.4 | 0.000208 | 0.101454 | A | Study 1 | CV082 | 313 | 313 |
| 39 | NC0151441 | 2 | 120.4 | 0.017129 | 0.003728 | G | Study 1 | CV006 | 313 | 313 |
| 39 | NC0151441 | 2 | 120.4 | 0.017129 | 0.003728 | G | Study 1 | CV006 | 313 | 313 |
| 39 | NC0151441 | 2 | 120.4 | 0.016277 | -0.0051 | A | Study 1 | CV010 | 313 | 313 |

CONT.

| QTL | Marker | Chr | pos | sig | effect | res allele | Mapping Study | Fav. Parent | SNP Position | SEQ ID |
|---|---|---|---|---|---|---|---|---|---|---|
| 39 | NC0084633 | 2 | 124.6 | -- | -- | G | Study 4 | -- | 357 | 314 |
| 39 | NC0084633 | 2 | 124.6 | -- | -- | G | Study 5 | -- | 357 | 314 |
| 39 | NC0084633 | 2 | 124.6 | 0.043822 | 0.005129 | G | Study 1 | CV024 | 357 | 314 |
| 39 | NC0000069 | 2 | 125.1 | 0.002325 | 0.022454 | G | Study 1 | CV048 | 162 | 315 |
| 39 | NC0000069 | 2 | 125.1 | 0.002056 | 0.0693 | A | Study 1 | CV074 | 162 | 315 |
| 39 | NC0000069 | 2 | 125.1 | 0.002922 | 0.021171 | A | Study 1 | CV074 | 162 | 315 |
| 39 | NC0000069 | 2 | 125.1 | 0.021137 | -0.0409 | G | Study 1 | CV010 | 162 | 315 |
| 39 | NC0000069 | 2 | 125.1 | 0.003305 | -0.00642 | G | Study 1 | CV010 | 162 | 315 |
| 39 | NC0000069 | 2 | 125.1 | 0.00292 | 0.271173 | G | Study 1 | CV130 | 162 | 315 |
| 39 | NC0082265 | 2 | 125.8 | 0.000964 | 0.024248 | C | Study 1 | CV048 | 479 | 316 |
| 39 | NC0082265 | 2 | 125.8 | 0.028205 | 0.084869 | C | Study 1 | CV059 | 479 | 316 |
| 39 | NC0082265 | 2 | 125.8 | 0.001851 | 0.008813 | C | Study 1 | CV141 | 479 | 316 |
| 39 | NC0082265 | 2 | 125.8 | 0.027962 | 0.173506 | T | Study 1 | CV073 | 479 | 316 |
| 39 | NC0082265 | 2 | 125.8 | 0.032023 | -0.05577 | T | Study 1 | CV057 | 479 | 316 |
| 39 | NC0082265 | 2 | 125.8 | 0.000519 | 0.213734 | C | Study 1 | CV159 | 479 | 316 |
| 39 | NC0082265 | 2 | 125.8 | 0 | 0.2862 | C | Study 1 | CV157 | 479 | 316 |
| 39 | NC0082265 | 2 | 125.8 | 0.041348 | 0.023271 | C | Study 1 | CV134 | 479 | 316 |
| 39 | NC0082265 | 2 | 125.8 | 0.000443 | -0.01891 | T | Study 1 | CV136 | 479 | 316 |
| 39 | NC0082265 | 2 | 125.8 | 0.000002 | -0.41007 | T | Study 1 | CV044 | 479 | 316 |
| 39 | NC0082265 | 2 | 125.8 | 0.045664 | 0.011881 | C | Study 1 | CV159 | 479 | 316 |
| 39 | NC0082265 | 2 | 125.8 | 0.03636 | -0.01429 | T | Study 1 | CV083 | 479 | 316 |
| 39 | NC0082265 | 2 | 125.8 | 0.003659 | -0.01858 | A | Study 1 | CV060 | 479 | 316 |
| 39 | NC0109393 | 2 | 127.1 | -- | -- | T | Study 5 | -- | 323 | 317 |
| 39 | NC0199804 | 2 | 127.1 | 0.0001 | 0.162443 | G | Study 3 | -- | 149 | 318 |
| 39 | NC0029138 | 2 | 127.6 | <.0001 | 0.162443 | G | Study 3 | -- | 290 | 319 |
| 39 | NC0029138 | 2 | 127.6 | -- | -- | G | Study 5 | -- | 290 | 319 |
| 39 | NC0040472 | 2 | 128.8 | 0 | 0.299027 | G | Study 1 | CV006 | 102 | 320 |
| 39 | NC0040472 | 2 | 128.8 | 0.020297 | -0.00458 | G | Study 1 | CV010 | 102 | 320 |
| 39 | NC0040472 | 2 | 128.8 | 0.00884 | -0.05495 | G | Study 1 | CV082 | 102 | 320 |
| 39 | NC0040472 | 2 | 128.8 | 0.020924 | 0.075676 | G | Study 1 | CV082 | 102 | 320 |
| 39 | NC0040472 | 2 | 128.8 | 0.000031 | 0.104956 | G | Study 1 | CV082 | 102 | 320 |
| 39 | NC0040472 | 2 | 128.8 | 0.025058 | -0.03696 | G | Study 1 | CV078 | 102 | 320 |
| 39 | NC0040472 | 2 | 128.8 | 0.000039 | 0.022753 | G | Study 1 | CV006 | 102 | 320 |
| 39 | NC0041850 | 2 | 128.8 | 0.035118 | -0.02118 | C | Study 1 | CV146 | 55 | 321 |

CONT.

| QTL | Marker | Chr | pos | sig | effect | res allele | Mapping Study | Fav. Parent | SNP Position | SEQ ID |
|---|---|---|---|---|---|---|---|---|---|---|
| 39 | NC0041850 | 2 | 128.8 | 0.008724 | -0.05615 | C | Study 1 | CV082 | 55 | 321 |
| 39 | NC0041850 | 2 | 128.8 | 0.000001 | -0.26547 | T | Study 1 | CV119 | 55 | 321 |
| 39 | NC0041850 | 2 | 128.8 | 0.044442 | 0.15162 | C | Study 1 | CV129 | 55 | 321 |
| 40 | NC0009102 | 2 | 130 | 0.028853 | -0.11616 | T | Study 1 | I294213 | 370 | 322 |
| 40 | NC0009102 | 2 | 130 | 0.009332 | 0.011575 | A | Study 1 | CV142 | 370 | 322 |
| 40 | NC0009102 | 2 | 130 | 0.026999 | 0.094089 | T | Study 1 | CV125 | 370 | 322 |
| 40 | NC0009102 | 2 | 130 | 0.016227 | 0.107382 | T | Study 1 | CV166 | 370 | 322 |
| 40 | NC0009102 | 2 | 130 | 0.007255 | -0.08444 | A | Study 1 | CV064 | 370 | 322 |
| 40 | NC0009102 | 2 | 130 | 0.009407 | 0.00867 | A | Study 1 | CV050 | 370 | 322 |
| 40 | NC0009102 | 2 | 130 | 0.003403 | 0.009065 | T | Study 1 | CV024 | 370 | 322 |
| 40 | NC0009102 | 2 | 130 | 0.000246 | -0.02085 | T | Study 1 | I294213 | 370 | 322 |
| 40 | NC0009102 | 2 | 130 | 0.000011 | -0.36583 | A | Study 1 | CV044 | 370 | 322 |
| 40 | NC0009102 | 2 | 130 | 0.035594 | 0.13242 | A | Study 1 | CV160 | 370 | 322 |
| 40 | NC0009102 | 2 | 130 | 0.035871 | 0.062491 | A | Study 1 | CV148 | 370 | 322 |
| 40 | NC0024089 | 2 | 130 | 0.000145 | -0.18033 | C | Study 1 | I294213 | 136 | 323 |
| 40 | NC0199876 | 2 | 132.1 | -- | -- | G | Study 5 | -- | 37 | 324 |
| 40 | NC0009818 | 2 | 136.5 | 0.047731 | -0.01301 | T | Study 1 | CV060 | 1 | 325 |
| 40 | NC0009818 | 2 | 136.5 | 0.000709 | 0.295212 | T | Study 1 | CV127 | 1 | 325 |
| 40 | NC0199317 | 2 | 138.2 | -- | -- | G | Study 5 | -- | 226 | 326 |
| 40 | NC0173731 | 2 | 138.4 | -- | -- | T | Study 5 | -- | 621 | 327 |
| 40 | NC0105556 | 2 | 139.5 | 0.010472 | 0.012248 | T | Study 5 | CV082 | 396 | 328 |
| 40 | NC0105556 | 2 | 139.5 | 0.00464 | -0.05964 | T | Study 1 | CV082 | 396 | 328 |
| 40 | NC0105556 | 2 | 139.5 | 0.000168 | 0.016899 | T | Study 1 | CV012 | 396 | 328 |
| 40 | NC0199382 | 2 | 139.5 | -- | -- | T | Study 5 | -- | 91 | 329 |
| 40 | NC0199713 | 2 | 139.5 | -- | -- | T | Study 5 | -- | 112 | 330 |
| 41 | NC0108103 | 2 | 140.7 | 0.002695 | 0.014301 | T | Study 1 | CV082 | 170 | 331 |
| 41 | NC0108103 | 2 | 140.7 | 0.000291 | -0.0785 | T | Study 1 | CV082 | 170 | 331 |
| 41 | NC0108103 | 2 | 140.7 | 0.023521 | 0.096353 | T | Study 1 | CV125 | 170 | 331 |
| 41 | NC0031474 | 2 | 141.4 | 0.045901 | -0.01384 | A | Study 1 | CV041 | 842 | 332 |
| 41 | NC0031474 | 2 | 141.4 | 0.026668 | -0.00432 | T | Study 1 | CV010 | 842 | 332 |
| 41 | NC0031474 | 2 | 141.4 | 0.002783 | -0.00632 | A | Study 1 | CV043 | 842 | 332 |

CONT.

| QTL | Marker | Chr | pos | sig | effect | res allele | Mapping Study | Fav. Parent | SNP Position | SEQ ID |
|---|---|---|---|---|---|---|---|---|---|---|
| 41 | NC0031474 | 2 | 141.4 | 0.010215 | 0.006765 | T | Study 1 | CV101 | 842 | 332 |
| 41 | NC0031474 | 2 | 141.4 | 0.028402 | -0.11553 | A | Study 1 | I294213 | 842 | 332 |
| 41 | NC0031474 | 2 | 141.4 | 0.032568 | 0.014102 | T | Study 1 | CV049 | 842 | 332 |
| 41 | NC0031474 | 2 | 141.4 | 0.005536 | 0.016917 | T | Study 1 | CV079 | 842 | 332 |
| 41 | NC0031474 | 2 | 141.4 | 0.034255 | -0.0057 | T | Study 1 | CV097 | 842 | 332 |
| 41 | NC0031474 | 2 | 141.4 | 0 | -0.29353 | A | Study 1 | CV119 | 842 | 332 |
| 41 | NC0031474 | 2 | 141.4 | 0.011389 | -0.04309 | T | Study 1 | CV010 | 842 | 332 |
| 41 | NC0031474 | 2 | 141.4 | 0.00672 | -0.00605 | T | Study 1 | CV010 | 842 | 332 |
| 41 | NC0031474 | 2 | 141.4 | 0.000024 | -0.02336 | A | Study 1 | I294213 | 842 | 332 |
| 41 | NC0031474 | 2 | 141.4 | 0.026675 | 0.02487 | T | Study 1 | CV165 | 842 | 332 |
| 41 | NC0031474 | 2 | 141.4 | 0.003599 | 0.028299 | T | Study 1 | CV165 | 842 | 332 |
| 41 | NC0031474 | 2 | 141.4 | 0.017347 | 0.0112 | T | Study 1 | CV012 | 842 | 332 |
| 41 | NC0031474 | 2 | 141.4 | 0.017347 | 0.0112 | T | Study 1 | CV012 | 842 | 332 |
| 41 | NC0031474 | 2 | 141.4 | 0.015232 | -0.01235 | A | Study 1 | I294213 | 842 | 332 |
| 41 | NC0002878 | 2 | 145.1 | 0.0037 | 0.103009 | C | Study 3 | - | 286 | 333 |
| 41 | NC0002878 | 2 | 145.1 | 0.000002 | -0.43414 | C | Study 1 | CV088 | 286 | 333 |
| 41 | NC0002878 | 2 | 145.1 | 0.014109 | 0.038411 | C | Study 1 | CV066 | 286 | 333 |
| 41 | NC0002878 | 2 | 145.1 | 0.010997 | 0.007557 | C | Study 1 | CV024 | 286 | 333 |
| 41 | NC0005088 | 2 | 147.6 | 0.002898 | -0.02921 | T | Study 1 | CV146 | 110 | 334 |
| 41 | NC0005088 | 2 | 147.6 | 0.001976 | 0.022686 | C | Study 1 | CV048 | 110 | 334 |
| 41 | NC0005088 | 2 | 147.6 | 0.032066 | 0.080362 | C | Study 1 | CV059 | 110 | 334 |
| 41 | NC0005088 | 2 | 147.6 | 0.000779 | -0.15924 | C | Study 1 | CV068 | 110 | 334 |
| 41 | NC0005088 | 2 | 147.6 | 0.000403 | 0.113782 | C | Study 1 | CV082 | 110 | 334 |
| 41 | NC0005088 | 2 | 147.6 | 0.000008 | 0.020123 | C | Study 1 | CV012 | 110 | 334 |
| 41 | NC0005088 | 2 | 147.6 | 0 | 0.3303 | C | Study 1 | CV159 | 110 | 334 |
| 41 | NC0005088 | 2 | 147.6 | 0 | 0.321654 | C | Study 1 | CV157 | 110 | 334 |
| 41 | NC0005088 | 2 | 147.6 | 0.013174 | 0.219292 | C | Study 1 | CV127 | 110 | 334 |
| 41 | NC0005088 | 2 | 147.6 | 0.00107 | -0.11007 | C | Study 1 | CV064 | 110 | 334 |
| 41 | NC0005088 | 2 | 147.6 | 0.011536 | -0.04207 | C | Study 1 | CV078 | 110 | 334 |
| 41 | NC0005088 | 2 | 147.6 | 0.001877 | 0.12908 | C | Study 1 | CV133 | 110 | 334 |
| 41 | NC0005088 | 2 | 147.6 | 0.024772 | 0.123122 | C | Study 1 | CV164 | 110 | 334 |
| 41 | NC0005088 | 2 | 147.6 | 0.02477 | 0.025368 | C | Study 1 | CV134 | 110 | 334 |
| 41 | NC0005088 | 2 | 147.6 | 0.029722 | -0.00637 | C | Study 1 | CV097 | 110 | 334 |

CONT.

| QTL | Marker | Chr | pos | sig | efect | res allele | Mapping Study | Fav. Parent | SNP Position | SEQ ID |
|---|---|---|---|---|---|---|---|---|---|---|
| 41 | NC0173482 | 2 | 148.3 | -- | -- | | Study 5 | -- | 1001 | 335 |
| 41 | NC0104694 | 2 | 148.4 | 0.028088 | 0.008228 | C | Study 1 | CV151 | 253 | 336 |
| 42 | NC0035297 | 2 | 150.7 | -- | -- | G | Study 4 | -- | 207 | 337 |
| 42 | NC0035297 | 2 | 150.7 | 0.002939 | -0.00668 | G | Study 1 | CV043 | 207 | 337 |
| 42 | NC0035297 | 2 | 150.7 | 0 | -0.46465 | G | Study 1 | CV088 | 207 | 337 |
| 42 | NC0035297 | 2 | 150.7 | 0.016139 | -0.13507 | A | Study 1 | I294213 | 207 | 337 |
| 42 | NC0035297 | 2 | 150.7 | 0.021731 | 0.006076 | A | Study 1 | CV101 | 207 | 337 |
| 42 | NC0035297 | 2 | 150.7 | 0.040244 | 0.022998 | A | Study 1 | CV165 | 207 | 337 |
| 42 | NC0035297 | 2 | 150.7 | 0.029416 | 0.02124 | A | Study 1 | CV165 | 207 | 337 |
| 42 | NC0035297 | 2 | 151.1 | 0.021721 | -0.17461 | A | Study 1 | CV044 | 250 | 338 |
| 42 | NC0155994 | 2 | 156.3 | -- | -- | T | Study 5 | -- | 55 | 339 |
| 42 | NC0170564 | 2 | 156.6 | -- | -- | T | Study 5 | -- | 327 | 340 |
| 42 | NC0034166 | 2 | 157.5 | 0.000012 | 0.251671 | C | Study 1 | CV006 | 340 | 341 |
| 42 | NC0019267 | 2 | 157.5 | 0.019472 | 0.017327 | C | Study 1 | CV048 | 340 | 341 |
| 42 | NC0019267 | 2 | 157.5 | 0.001622 | 0.014919 | C | Study 1 | CV082 | 340 | 341 |
| 42 | NC0019267 | 2 | 157.5 | 0 | -0.23732 | C | Study 1 | CV068 | 340 | 341 |
| 42 | NC0019267 | 2 | 157.5 | 0 | 0.140418 | C | Study 1 | CV082 | 340 | 341 |
| 42 | NC0019267 | 2 | 157.5 | 0.008321 | 0.008533 | C | Study 1 | CV082 | 340 | 341 |
| 42 | NC0019267 | 2 | 157.5 | 0.011146 | 0.011329 | C | Study 1 | CV100 | 340 | 341 |
| 42 | NC0019267 | 2 | 157.5 | 0 | 0.015872 | C | Study 1 | CV141 | 340 | 341 |
| 42 | NC0019267 | 2 | 157.5 | 0.000836 | -0.10276 | C | Study 1 | CV064 | 340 | 341 |
| 42 | NC0019267 | 2 | 157.5 | 0.000953 | 0.297871 | C | Study 1 | CV130 | 340 | 341 |
| 42 | NC0019267 | 2 | 157.5 | 0.000171 | 0.229627 | C | Study 1 | CV160 | 340 | 341 |
| 42 | NC0019267 | 2 | 157.5 | 0.0002 | -0.01735 | C | Study 1 | CV082 | 340 | 341 |
| 42 | NC0019267 | 2 | 157.5 | 0.000621 | 0.018867 | C | Study 1 | CV006 | 340 | 341 |
| 43 | NC0043579 | 2 | 163.8 | -- | -- | T | Study 5 | -- | 154 | 342 |
| 43 | NC0043579 | 2 | 163.8 | 0.004419 | 0.322909 | T | Study 1 | CV124 | 154 | 342 |
| 43 | NC0147548 | 2 | 163.8 | -- | -- | G | Study 5 | -- | 1001 | 343 |
| 43 | NC0147548 | 2 | 163.8 | 0 | 0.016551 | G | Study 1 | CV141 | 1001 | 343 |
| 43 | NC0005214 | 2 | 164.3 | 0.000014 | -0.09133 | C | Study 1 | CV082 | 218 | 344 |
| 43 | NC0005214 | 2 | 164.3 | 0.001151 | 0.137292 | T | Study 1 | CV166 | 218 | 344 |
| 43 | NC0199851 | 2 | 165.2 | -- | -- | C | Study 5 | -- | 341 | 345 |
| 43 | NC0199466 | 2 | 165.4 | -- | -- | G | Study 5 | -- | 74 | 346 |

CONT.

| QTL | Marker | Chr | pos | sig | effect | res allele | Mapping Study | Fav. Parent | SNP Position | SEQ ID |
|---|---|---|---|---|---|---|---|---|---|---|
| 43 | NC0014467 | 2 | 167.3 | 0.0011 | 0.088551 | ** | Study 3 | -- | 366 | 347 |
| 43 | NC0014467 | 2 | 167.3 | 0.000117 | -0.00669 | ** | Study 1 | CV010 | 366 | 347 |
| 43 | NC0014467 | 2 | 167.3 | 0.038914 | 0.075532 | AT | Study 1 | CV059 | 366 | 347 |
| 43 | NC0014467 | 2 | 167.3 | 0.023789 | 0.047819 | AT | Study 1 | CV006 | 366 | 347 |
| 43 | NC0014467 | 2 | 167.3 | 0.000033 | -0.08691 | ** | Study 1 | CV082 | 366 | 347 |
| 43 | NC0014467 | 2 | 167.3 | 0.000001 | 0.155998 | ** | Study 1 | CV082 | 366 | 347 |
| 43 | NC0014467 | 2 | 167.3 | 0.009938 | 0.009692 | AT | Study 1 | CV151 | 366 | 347 |
| 43 | NC0014467 | 2 | 167.3 | 0.008149 | 0.040634 | AT | Study 1 | CV066 | 366 | 347 |
| 43 | NC0014467 | 2 | 167.3 | 0.048246 | 0.012347 | AT | Study 1 | CV079 | 366 | 347 |
| 43 | NC0014467 | 2 | 167.3 | 0 | 0.284618 | ** | Study 1 | CV157 | 366 | 347 |
| 43 | NC0014467 | 2 | 167.3 | 0.000645 | -0.1822 | ** | Study 1 | CV119 | 366 | 347 |
| 43 | NC0014467 | 2 | 167.3 | 0.034941 | -0.00765 | ** | Study 1 | CV116 | 366 | 347 |
| 43 | NC0014467 | 2 | 167.3 | 0.034941 | -0.00765 | ** | Study 1 | CV116 | 366 | 347 |
| 43 | NC0014467 | 2 | 167.3 | 0.044716 | -0.01692 | AT | Study 1 | CV063 | 366 | 347 |
| 43 | NC0003241 | 2 | 169.8 | 0.005198 | 0.15577 | A | Study 1 | CV006 | 214 | 348 |
| 43 | NC0003241 | 2 | 169.8 | 0.015206 | -0.00597 | G | Study 1 | CV056 | 214 | 348 |
| 43 | NC0003241 | 2 | 169.8 | 0.04449 | 0.24082 | A | Study 1 | CV156 | 214 | 348 |
| 43 | NC0003241 | 2 | 169.8 | 0.002082 | 0.034377 | A | Study 1 | CV134 | 214 | 348 |
| 44 | NC0033320 | 2 | 173.6 | -- | -- | G | Study 5 | -- | 209 | 349 |
| 44 | NC0033320 | 2 | 173.6 | 0.009771 | -0.01329 | C | Study 1 | CV010 | 209 | 349 |
| 44 | NC0008930 | 2 | 174.2 | 0.000002 | -0.04467 | A | Study 1 | CV146 | 82 | 350 |
| 44 | NC0008930 | 2 | 174.2 | 0 | -0.34191 | G | Study 1 | CV068 | 82 | 350 |
| 44 | NC0008930 | 2 | 174.2 | 0.00493 | -0.0247 | G | Study 1 | CV010 | 82 | 350 |
| 44 | NC0029041 | 2 | 174.2 | 0 | -0.04086 | A | Study 1 | CV095 | 406 | 351 |
| 44 | NC0029041 | 2 | 174.2 | 0.019386 | -0.00402 | A | Study 1 | CV094 | 406 | 351 |
| 44 | NC0029041 | 2 | 174.2 | 0.00299 | -0.01268 | C | Study 1 | CV095 | 406 | 351 |
| 44 | NC0029041 | 2 | 174.2 | 0.04237 | -0.1692 | A | Study 1 | CV044 | 406 | 351 |
| 44 | NC0029041 | 2 | 174.2 | 0.000522 | 0.194154 | C | Study 1 | CV160 | 406 | 351 |
| 45 | NC0023748 | 2 | 181.9 | 0.029265 | 0.016027 | A | Study 1 | CV048 | 61 | 352 |
| 45 | NC0023748 | 2 | 181.9 | 0 | -0.33494 | C | Study 1 | CV068 | 61 | 352 |
| 45 | NC0023748 | 2 | 181.9 | 0.005586 | 0.030912 | A | Study 1 | CV134 | 61 | 352 |
| 45 | NC0023748 | 2 | 181.9 | 0.019941 | 0.010125 | C | Study 1 | CV145 | 61 | 352 |
| 45 | NC0104359 | 2 | 182.5 | -- | -- | C | Study 5 | -- | 386 | 353 |

CONT.

| QTL | Marker | Chr | pos | sig | effect | res allele | Mapping Study | Fav. Parent | SNP Position | SEQ ID |
|---|---|---|---|---|---|---|---|---|---|---|
| 45 | NC0104359 | 2 | 182.5 | 0.017561 | 0.010464 | C | Study 1 | CV012 | 386 | 353 |
| 45 | NC0104359 | 2 | 182.5 | 0.0093 | -0.00404 | C | Study 1 | CV094 | 386 | 353 |
| 45 | NC0035238 | 2 | 185.5 | 0 | 0.150158 | A | Study 1 | CV082 | 80 | 354 |
| 45 | NC0035238 | 2 | 185.5 | 0.00024 | 0.010939 | A | Study 1 | CV082 | 80 | 354 |
| 45 | NC0110974 | 2 | 185.5 | 0.005952 | 0.048497 | T | Study 1 | CV100 | 522 | 355 |
| 45 | NC0110974 | 2 | 185.5 | 0.001515 | 0.013772 | T | Study 1 | CV100 | 522 | 355 |
| 45 | NC0110974 | 2 | 185.5 | 0.003305 | 0.008226 | T | Study 1 | CV141 | 522 | 355 |
| 45 | NC0110974 | 2 | 185.5 | 0.043416 | 0.150624 | T | Study 1 | CV129 | 522 | 355 |
| 45 | NC0110974 | 2 | 185.5 | 0.036162 | 0.032427 | T | Study 1 | CV066 | 522 | 355 |
| 45 | NC0110974 | 2 | 185.5 | 0.042929 | 0.145214 | T | Study 1 | CV163 | 522 | 355 |
| 45 | NC0110974 | 2 | 185.5 | 0.004411 | 0.017228 | T | Study 1 | CV079 | 522 | 355 |
| 45 | NC0110974 | 2 | 185.5 | 0.041815 | -0.11236 | C | Study 1 | CV119 | 522 | 355 |
| 45 | NC0110974 | 2 | 185.5 | 0.020928 | -0.15519 | C | Study 1 | I294213 | 522 | 355 |
| 45 | NC0110974 | 2 | 185.5 | 0.040998 | 0.025217 | C | Study 1 | CV119 | 522 | 355 |
| 45 | NC0110974 | 2 | 185.5 | 0.001444 | -0.0543 | T | Study 1 | CV010 | 522 | 355 |
| 45 | NC0110974 | 2 | 185.5 | 0.013212 | -0.01307 | T | Study 1 | CV129 | 522 | 355 |
| 46 | NC0107149 | 2 | 190.1 | 0.001408 | -0.03228 | A | Study 1 | CV146 | 220 | 356 |
| 46 | NC0076792 | 2 | 190.8 | 0.030887 | 0.017106 | G | Study 1 | CV165 | 195 | 357 |
| 46 | NC0076792 | 2 | 190.8 | 0.000742 | 0.20626 | G | Study 1 | CV159 | 195 | 357 |
| 46 | NC0011740 | 2 | 190.9 | 0.035279 | 0.120232 | G | Study 1 | CV006 | 112 | 358 |
| 46 | NC0011740 | 2 | 190.9 | 0.023274 | -0.00419 | A | Study 1 | CV010 | 112 | 358 |
| 46 | NC0011740 | 2 | 190.9 | 0.014084 | -0.00626 | A | Study 1 | CV056 | 112 | 358 |
| 46 | NC0011740 | 2 | 190.9 | 0.004685 | 0.056636 | G | Study 1 | CV006 | 112 | 358 |
| 46 | NC0011740 | 2 | 190.9 | 0.002092 | -0.0744 | A | Study 1 | CV022 | 112 | 358 |
| 46 | NC0011740 | 2 | 190.9 | 0.013534 | -0.00894 | A | Study 1 | CV116 | 112 | 358 |
| 46 | NC0011740 | 2 | 190.9 | 0.013534 | -0.00894 | A | Study 1 | CV116 | 112 | 358 |
| 46 | NC0011740 | 2 | 190.9 | 0.043876 | -0.01181 | A | Study 1 | CV093 | 112 | 358 |
| 46 | NC0000735 | 2 | 191.5 | 0.00132 | 0.107817 | A | Study 1 | CV082 | 94 | 359 |
| 46 | NC0000735 | 2 | 191.5 | 0.015018 | 0.098464 | A | Study 1 | CV133 | 94 | 359 |
| 46 | NC0000735 | 2 | 191.5 | 0 | -0.02464 | G | Study 1 | CV082 | 94 | 359 |
| 46 | NC0077782 | 2 | 191.5 | 0.000562 | -0.07045 | A | Study 1 | CV082 | 280 | 360 |
| 47 | NC0020971 | 3 | 13.9 | 0.048247 | 0.019343 | A | Study 1 | CV127 | 56 | 361 |
| 47 | NC0020971 | 3 | 13.9 | 0.011424 | 0.014478 | C | Study 1 | CV159 | 56 | 361 |

CONT.

| QTL | Marker | Chr | pos | sig | effect | res allele | Mapping Study | Fav. Parent | SNP Position | SEQ ID |
|---|---|---|---|---|---|---|---|---|---|---|
| 47 | NC0106389 | 3 | 14.2 | 0.044642 | -0.00976 | G | Study 1 | CV053 | 207 | 362 |
| 47 | NC0106389 | 3 | 14.2 | 0.01216 | 0.005515 | G | Study 1 | CV051 | 207 | 362 |
| 47 | NC0106389 | 3 | 14.2 | 0.001438 | 0.166402 | G | Study 1 | CV125 | 207 | 362 |
| 47 | NC0106389 | 3 | 14.2 | 0.027959 | -0.09036 | A | Study 1 | CV045 | 207 | 362 |
| 47 | NC0106389 | 3 | 14.2 | 0.039192 | 0.047284 | A | Study 1 | CV150 | 207 | 362 |
| 47 | NC0106389 | 3 | 14.2 | 0.04557 | 0.051677 | A | Study 1 | CV150 | 207 | 362 |
| 47 | NC0008911 | 3 | 19.9 | 0.008483 | -0.14437 | A | Study 1 | CV053 | 205 | 363 |
| 47 | NC0008911 | 3 | 19.9 | 0.029951 | -0.07177 | G | Study 1 | CV101 | 205 | 363 |
| 47 | NC0008911 | 3 | 19.9 | 0.048638 | 0.10911 | G | Study 1 | CV160 | 205 | 363 |
| 47 | NC0051614 | 3 | 19.9 | <.0001 | -0.15286 | C | Study 3 | - | 320 | 364 |
| 48 | NC0106276 | 3 | 20 | 0.011321 | 0.017673 | T | Study 1 | CV140 | 343 | 365 |
| 49 | NC0048700 | 3 | 31.3 | 0.00196 | 0.01503 | T | Study 1 | CV069 | 85 | 366 |
| 50 | NC0032137 | 3 | 40.2 | 0.000064 | 0.027386 | * | Study 1 | CV140 | 216 | 367 |
| 50 | NC0032137 | 3 | 40.2 | 0.0458 | 0.244653 | A | Study 1 | CV156 | 216 | 367 |
| 50 | NC0032137 | 3 | 40.2 | 0.000335 | 0.187271 | A | Study 1 | CV125 | 216 | 367 |
| 50 | NC0032137 | 3 | 40.2 | 0.036187 | 0.016821 | A | Study 1 | CV156 | 216 | 367 |
| 50 | NC0032137 | 3 | 40.2 | 0.000155 | 0.10919 | A | Study 1 | CV150 | 216 | 367 |
| 50 | NC0032137 | 3 | 40.2 | 0.000068 | 0.129608 | A | Study 1 | CV150 | 216 | 367 |
| 50 | NC0032137 | 3 | 40.2 | 0.033677 | -0.01292 | A | Study 1 | CV077 | 216 | 367 |
| 50 | NC0032137 | 3 | 40.2 | 0.037026 | 0.017098 | A | Study 1 | CV069 | 216 | 367 |
| 50 | NC0019963 | 3 | 40.6 | 0.000174 | -0.20703 | C | Study 1 | CV053 | 1173 | 368 |
| 50 | NC0019963 | 3 | 40.6 | 0.008851 | -0.0867 | C | Study 1 | CV101 | 1173 | 368 |
| 50 | NC0019963 | 3 | 40.6 | 0.03865 | -0.01042 | A | Study 1 | CV098 | 1173 | 368 |
| 50 | NC0019963 | 3 | 40.6 | 0.010236 | -0.0122 | A | Study 1 | CV053 | 1173 | 368 |
| 50 | NC0019963 | 3 | 40.6 | 0.003252 | -0.00928 | A | Study 1 | 1294213 | 1173 | 368 |
| 50 | NC0019963 | 3 | 40.6 | 0.014632 | 0.016755 | C | Study 1 | CV165 | 1173 | 368 |
| 50 | NC0019963 | 3 | 40.6 | 0.048093 | -0.03522 | A | Study 1 | CV070 | 1173 | 368 |
| 50 | NC0019963 | 3 | 40.6 | 0.043223 | 0.014891 | A | Study 1 | CV150 | 1173 | 368 |
| 50 | NC0019963 | 3 | 40.6 | 0.004419 | 0.016628 | A | Study 1 | CV150 | 1173 | 368 |
| 50 | NC0000423 | 3 | 49.9 | 0.0003 | -0.13506 | A | Study 3 | - | 73 | 369 |
| 50 | NC0000423 | 3 | 49.9 | 0.000002 | 0.03237 | G | Study 1 | CV140 | 73 | 369 |
| 50 | NC0000423 | 3 | 49.9 | 0.001362 | -0.01547 | G | Study 1 | CV053 | 73 | 369 |
| 50 | NC0000423 | 3 | 49.9 | 0.006818 | 0.014473 | G | Study 1 | CV006 | 73 | 369 |

CONT.

| QTL | Marker | Chr | pos | sig | effect | res allele | Mapping Study | Fav. Parent | SNP Position | SEQ ID |
|---|---|---|---|---|---|---|---|---|---|---|
| 50 | NC0000423 | 3 | 49.9 | 0.023055 | -0.05951 | A | Study 1 | CV082 | 73 | 369 |
| 50 | NC0000423 | 3 | 49.9 | 0.023311 | 0.019632 | G | Study 1 | CV006 | 73 | 369 |
| 50 | NC0000423 | 3 | 49.9 | 0.000607 | 0.178185 | A | Study 1 | CV125 | 73 | 369 |
| 50 | NC0000423 | 3 | 49.9 | 0.001731 | 0.114882 | A | Study 1 | CV079 | 73 | 369 |
| 50 | NC0000423 | 3 | 49.9 | 0.000326 | 0.145471 | A | Study 1 | CV079 | 73 | 369 |
| 50 | NC0000423 | 3 | 49.9 | 0.012886 | -0.01578 | A | Study 1 | CV063 | 73 | 369 |
| 51 | NC0106329 | 3 | 53.9 | 0.000052 | -0.22602 | A | Study 1 | CV053 | 73 | 370 |
| 51 | NC0106329 | 3 | 53.9 | 0.021272 | 0.012684 | G | Study 1 | CV006 | 73 | 370 |
| 51 | NC0004821 | 3 | 54.4 | -- | -- | T | Study 5 | -- | 294 | 371 |
| 51 | NC0004821 | 3 | 54.4 | 0.000203 | -0.20704 | T | Study 1 | CV053 | 294 | 371 |
| 51 | NC0004821 | 3 | 54.4 | 0.000002 | -0.1563 | C | Study 1 | CV101 | 294 | 371 |
| 51 | NC0004821 | 3 | 54.4 | 0.011365 | 0.020401 | C | Study 1 | CV156 | 294 | 371 |
| 51 | NC0004821 | 3 | 54.4 | 0.000026 | 0.121594 | C | Study 1 | CV150 | 294 | 371 |
| 51 | NC0004821 | 3 | 54.4 | 0.000001 | 0.156172 | C | Study 1 | CV150 | 294 | 371 |
| 51 | NC0004821 | 3 | 54.4 | 0.009933 | -0.01624 | C | Study 1 | CV077 | 294 | 371 |
| 52 | NC0148268 | 3 | 60.8 | 0.000156 | 0.027356 | GAG | Study 1 | CV140 | 139 | 372 |
| 52 | NC0148268 | 3 | 60.8 | 0.001667 | -0.08546 | *** | Study 1 | CV082 | 139 | 372 |
| 52 | NC0008520 | 3 | 62 | -- | -- | G | Study 5 | -- | 267 | 373 |
| 52 | NC0049293 | 3 | 69.9 | 0.018849 | -0.01146 | A | Study 1 | CV053 | 183 | 374 |
| 52 | NC0049293 | 3 | 69.9 | 0 | 0.267493 | C | Study 1 | CV149 | 183 | 374 |
| 52 | NC0049293 | 3 | 69.9 | 0.009754 | 0.175089 | C | Study 1 | CV149 | 183 | 374 |
| 53 | NC0108727 | 3 | 77.4 | -- | -- | G | Study 5 | -- | 241 | 375 |
| 53 | NC0108727 | 3 | 77.4 | 0.022183 | -0.14469 | C | Study 1 | CV131 | 241 | 375 |
| 53 | NC0108727 | 3 | 77.4 | 0.000765 | -0.20123 | C | Study 1 | CV053 | 241 | 375 |
| 53 | NC0108727 | 3 | 77.4 | 0.046371 | -0.00672 | C | Study 1 | I294213 | 241 | 375 |
| 53 | NC0108727 | 3 | 77.4 | 0 | -0.20792 | C | Study 1 | CV101 | 241 | 375 |
| 53 | NC0108727 | 3 | 77.4 | 0.003952 | 0.015425 | C | Study 1 | CV006 | 241 | 375 |
| 53 | NC0108727 | 3 | 77.4 | 0.022316 | 0.018668 | C | Study 1 | CV006 | 241 | 375 |
| 53 | NC0108727 | 3 | 77.4 | 0.000003 | 0.024261 | C | Study 1 | CV005 | 241 | 375 |
| 53 | NC0108727 | 3 | 77.4 | 0.001818 | 0.016278 | C | Study 1 | CV006 | 241 | 375 |
| 53 | NC0108727 | 3 | 77.4 | 0.004648 | 0.019024 | C | Study 1 | CV014 | 241 | 375 |
| 54 | NC0199324 | 3 | 81.8 | -- | -- | G | Study 5 | -- | 115 | 376 |
| 54 | NC0004599 | 3 | 82.9 | -- | -- | T | Study 4 | -- | 105 | 377 |

CONT.

| QTL | Marker | Chr | pos | sig | effect | res allele | Mapping Study | Fav. Parent | SNP Position | SEQ ID |
|---|---|---|---|---|---|---|---|---|---|---|
| 54 | NC0021154 | 3 | 82.9 | 0.000983 | 0.025768 | C | Study 1 | CV140 | 55 | 378 |
| 54 | NC0021154 | 3 | 82.9 | 0.030793 | -0.01372 | T | Study 1 | CV063 | 55 | 378 |
| 54 | NC0147768 | 3 | 82.9 | -- | -- | T | Study 4 | -- | 418 | 379 |
| 54 | NC0028923 | 3 | 83.1 | 0.000004 | -0.13252 | G | Study 1 | CV082 | 1052 | 380 |
| 54 | NC0105291 | 3 | 83.2 | 0.014407 | 0.098731 | C | Study 1 | CV114 | 294 | 381 |
| 54 | NC0106515 | 3 | 83.2 | -- | -- | T | Study 4 | -- | 184 | 382 |
| 54 | NC0106515 | 3 | 83.2 | 0.009472 | -0.06964 | G | Study 1 | CV050 | 184 | 382 |
| 54 | NC0106515 | 3 | 83.2 | 0.000179 | 0.013858 | G | Study 1 | CV151 | 184 | 382 |
| 54 | NC0106515 | 3 | 83.2 | 0.000491 | 0.091156 | G | Study 1 | CV050 | 184 | 382 |
| 54 | NC0106515 | 3 | 83.2 | 0.022442 | 0.018319 | G | Study 1 | CV156 | 184 | 382 |
| 54 | NC0106515 | 3 | 83.2 | 0.001193 | 0.035936 | G | Study 1 | CV165 | 184 | 382 |
| 54 | NC0106515 | 3 | 83.2 | 0.001333 | 0.030989 | G | Study 1 | CV165 | 184 | 382 |
| 54 | NC0106515 | 3 | 83.2 | 0 | 0.181127 | G | Study 1 | CV150 | 184 | 382 |
| 54 | NC0106515 | 3 | 83.2 | 0 | 0.225564 | G | Study 1 | CV150 | 184 | 382 |
| 54 | NC0110326 | 3 | 83.2 | -- | -- | T | Study 4 | -- | 263 | 383 |
| 54 | NC0110326 | 3 | 83.2 | 0.00555 | 0.119212 | T | Study 1 | CV116 | 263 | 383 |
| 54 | NC0110326 | 3 | 83.2 | 0.000909 | 0.12209 | T | Study 1 | CV079 | 263 | 383 |
| 54 | NC0110326 | 3 | 83.2 | 0.00016 | 0.153677 | T | Study 1 | CV079 | 263 | 383 |
| 54 | NC0173514 | 3 | 83.2 | -- | -- | T | Study 5 | -- | 628 | 384 |
| 54 | NC0173790 | 3 | 83.5 | -- | -- | G | Study 5 | -- | 979 | 385 |
| 54 | NC0021190 | 3 | 83.5 | 0 | -0.20089 | G | Study 4 | CV101 | 284 | 386 |
| 54 | NC0021190 | 3 | 83.5 | 0.005804 | 0.014969 | G | Study 1 | CV006 | 284 | 386 |
| 54 | NC0021190 | 3 | 83.5 | 0.005699 | -0.01907 | G | Study 1 | CV077 | 284 | 386 |
| 54 | NC0021190 | 3 | 83.5 | 0.000046 | 0.025734 | G | Study 1 | CV014 | 284 | 386 |
| 54 | NC0010220 | 3 | 83.6 | -- | -- | T | Study 4 | -- | 291 | 387 |
| 54 | NC0012017 | 3 | 85.7 | 0 | 0.033962 | T | Study 1 | CV005 | 135 | 388 |
| 54 | NC0016729 | 3 | 86.8 | <.0001 | 0.131989 | T | Study 3 | -- | 100 | 389 |
| 54 | NC0016729 | 3 | 86.8 | -- | -- | T | Study 4 | -- | 100 | 389 |
| 54 | NC0016729 | 3 | 86.8 | -- | -- | T | Study 5 | -- | 100 | 389 |
| 54 | NC0145322 | 3 | 87.1 | <.0001 | -0.23068 | C | Study 3 | -- | 708 | 390 |
| 54 | NC0002207 | 3 | 87.9 | 0.000101 | 0.369414 | T | Study 1 | CV161 | 494 | 391 |
| 54 | NC0002207 | 3 | 87.9 | 0.015374 | 0.011986 | C | Study 1 | CV069 | 494 | 391 |

CONT.

| QTL | Marker | Chr | pos | sig | effect | res allele | Mapping Study | Fav. Parent | SNP Position | SEQ ID |
|---|---|---|---|---|---|---|---|---|---|---|
| 54 | NC0009468 | 3 | 88 | -- | -- | G | Study 4 | -- | 102 | 392 |
| 54 | NC0009470 | 3 | 88 | 1.61E-12 | 0.201223 | C | Study 2 | -- | 137 | 393 |
| 54 | NC0194580 | 3 | 89.1 | -- | -- | G | Study 5 | -- | 284 | 394 |
| 54 | NC0031647 | 3 | 89.5 | -- | -- | T | Study 4 | CV010 | 899 | 395 |
| 54 | NC0031647 | 3 | 89.5 | 0.004966 | -0.01206 | T | Study 1 | CV010 | 899 | 395 |
| 55 | NC0040104 | 3 | 92.2 | 0.015433 | 0.016783 | T | Study 1 | CV165 | 143 | 396 |
| 55 | NC0106440 | 3 | 92.3 | 0.022692 | -0.00705 | A | Study 1 | CV089 | 450 | 397 |
| 55 | NC0109509 | 3 | 93.7 | -- | -- | G | Study 4 | -- | 54 | 398 |
| 55 | NC0035187 | 3 | 93.9 | 0.000817 | 0.018185 | G | Study 1 | CV006 | 293 | 399 |
| 55 | NC0146158 | 3 | 94 | 0.000902 | 0.172859 | * | Study 1 | CV125 | 822 | 400 |
| 55 | NC0146158 | 3 | 94 | 0.020325 | 0.018704 | * | Study 1 | CV156 | 822 | 400 |
| 55 | NC0039785 | 3 | 94.5 | -- | -- | T | Study 4 | -- | 512 | 401 |
| 55 | NC0039785 | 3 | 94.5 | 0.02233 | -0.00723 | T | Study 1 | CV089 | 512 | 401 |
| 55 | NC0082153 | 3 | 94.5 | 0.0027 | -0.07526 | A | Study 3 | -- | 162 | 402 |
| 55 | NC0082160 | 3 | 94.5 | -- | -- | G | Study 5 | -- | 334 | 403 |
| 55 | NC0200047 | 3 | 96.1 | -- | -- | G | Study 5 | -- | 98 | 404 |
| 55 | NC0200156 | 3 | 96.1 | -- | -- | G | Study 5 | -- | 204 | 405 |
| 55 | NC0008900 | 3 | 97.6 | 4.46E-13 | 0.209643 | A | Study 2 | -- | 275 | 406 |
| 55 | NC0008900 | 3 | 97.6 | 0.017875 | -0.15091 | G | Study 1 | CV131 | 275 | 406 |
| 55 | NC0008900 | 3 | 97.6 | 0.008202 | -0.01946 | G | Study 1 | CV041 | 275 | 406 |
| 55 | NC0010933 | 3 | 99.3 | -- | -- | T | Study 5 | -- | 508 | 407 |
| 55 | NC0010933 | 3 | 99.3 | 0.015683 | 0.018522 | T | Study 1 | CV140 | 508 | 407 |
| 55 | NC0010933 | 3 | 99.3 | 0.028218 | -0.13555 | T | Study 1 | CV041 | 508 | 407 |
| 55 | NC0010933 | 3 | 99.3 | 0.028498 | -0.17619 | G | Study 1 | CV044 | 508 | 407 |
| 55 | NC0031720 | 3 | 99.3 | 0 | 0.321823 | G | Study 1 | CV149 | 434 | 408 |
| 55 | NC0031720 | 3 | 99.7 | 0.008492 | -0.00817 | G | Study 1 | CV089 | 434 | 408 |
| 55 | NC0009739 | 3 | 99.7 | 0.000431 | 0.322949 | G | Study 1 | CV161 | 284 | 409 |
| 56 | NC0022590 | 3 | 102.2 | 0.042886 | 0.009577 | T | Study 1 | CV081 | 83 | 410 |
| 56 | NC0022590 | 3 | 104 | 0.005452 | 0.023224 | T | Study 1 | CV006 | 83 | 410 |
| 56 | NC0022590 | 3 | 104 | 0.049688 | 0.003247 | T | Study 1 | CV099 | 83 | 410 |
| 56 | NC0022590 | 3 | 104 | 0.007023 | 0.012766 | T | Study 1 | CV145 | 83 | 410 |
| 56 | NC0104504 | 3 | 104 | -- | -- | G | Study 5 | -- | 406 | 411 |
| 56 | NC0104504 | 3 | 104 | 0.007808 | -0.15689 | A | Study 1 | CV053 | 406 | 411 |

CONT.

| QTL | Marker | Chr | pos | sig | effect | res allele | Mapping Study | Fav. Parent | SNP Position | SEQ ID |
|---|---|---|---|---|---|---|---|---|---|---|
| 56 | NC0104504 | 3 | 104 | 0.018264 | -0.00921 | G | Study 1 | CV090 | 406 | 411 |
| 56 | NC0013092 | 3 | 105.4 | 0.000025 | 0.189889 | C | Study 1 | CV116 | 369 | 412 |
| 56 | NC0107469 | 3 | 106.3 | -- | -- | T | Study 5 | -- | 341 | 413 |
| 56 | NC0108089 | 3 | 106.3 | <.0001 | 0.209948 | ** | Study 3 | -- | 274 | 414 |
| 56 | NC0108089 | 3 | 106.3 | -- | -- | ** | Study 4 | -- | 274 | 414 |
| 56 | NC0108089 | 3 | 106.3 | 0.006447 | -0.01624 | ** | Study 1 | CV025 | 274 | 414 |
| 56 | NC0154151 | 3 | 109.3 | 0.000443 | 0.093358 | G | Study 1 | CV168 | 182 | 415 |
| 56 | NC0154151 | 3 | 109.3 | 0 | -0.19628 | A | Study 1 | CV101 | 182 | 415 |
| 56 | NC0154151 | 3 | 109.3 | 0.00069 | -0.05905 | A | Study 1 | CV010 | 182 | 415 |
| 56 | NC0154151 | 3 | 109.3 | 0.013453 | -0.0107 | A | Study 1 | CV010 | 182 | 415 |
| 56 | NC0154151 | 3 | 109.3 | 0.015414 | 0.009173 | A | Study 1 | CV151 | 182 | 415 |
| 56 | NC0154151 | 3 | 109.3 | 0.00061 | 0.021724 | A | Study 1 | CV014 | 182 | 415 |
| 56 | NC0154505 | 3 | 109.3 | 0.018355 | -0.06512 | T | Study 1 | CV050 | 126 | 416 |
| 56 | NC0154505 | 3 | 109.3 | 0.039604 | 0.015328 | T | Study 1 | CV150 | 126 | 416 |
| 56 | NC0154616 | 3 | 109.3 | -- | -- | C | Study 5 | -- | 216 | 417 |
| 56 | NC0155689 | 3 | 109.3 | <.0001 | 0.385927 | T | Study 3 | -- | 231 | 418 |
| 57 | NC0155775 | 3 | 111.4 | -- | -- | G | Study 4 | -- | 162 | 419 |
| 57 | NC0155775 | 3 | 111.4 | 0.009072 | 0.105845 | G | Study 1 | CV114 | 162 | 419 |
| 57 | NC0144126 | 3 | 111.6 | 0.000006 | 0.231245 | A | Study 1 | CV125 | 233 | 420 |
| 57 | NC0055894 | 3 | 112.4 | -- | -- | T | Study 4 | -- | 202 | 421 |
| 57 | NC0055894 | 3 | 112.4 | 0.028738 | -0.0113 | T | Study 1 | CV014 | 202 | 421 |
| 57 | NC0024395 | 3 | 116 | 0.015486 | 0.013618 | T | Study 1 | CV141 | 75 | 422 |
| 57 | NC0024395 | 3 | 116 | 0.000373 | 0.126134 | T | Study 1 | CV079 | 75 | 422 |
| 57 | NC0024395 | 3 | 116 | 0.000022 | 0.165958 | T | Study 1 | CV079 | 75 | 422 |
| 57 | NC0024395 | 3 | 116 | 0 | 0.146535 | T | Study 1 | CV150 | 75 | 422 |
| 57 | NC0024395 | 3 | 116 | 0 | 0.209881 | T | Study 1 | CV150 | 75 | 422 |
| 57 | NC0079081 | 3 | 117.1 | 0.022233 | -0.08334 | C | Study 1 | CV041 | 78 | 423 |
| 57 | NC0079081 | 3 | 117.1 | 0.005235 | 0.023594 | A | Study 1 | CV006 | 78 | 423 |
| 57 | NC0079081 | 3 | 117.1 | 0.002301 | 0.016044 | A | Study 1 | CV005 | 78 | 423 |
| 57 | NC0079081 | 3 | 117.1 | 0.044123 | -0.01155 | A | Study 1 | CV076 | 78 | 423 |
| 57 | NC0079081 | 3 | 117.1 | 0.006 | 0.015106 | A | Study 1 | CV006 | 78 | 423 |
| 57 | NC0111959 | 3 | 117.6 | 0.000511 | 0.158732 | ** | Study 1 | CV116 | 71 | 424 |
| 57 | NC0111959 | 3 | 117.6 | 0.004949 | -0.07922 | GT | Study 1 | CV082 | 71 | 424 |

CONT.

| QTL | Marker | Chr | pos | sig | effect | res allele | Mapping Study | Fav. Parent | SNP Position | SEQ ID |
|---|---|---|---|---|---|---|---|---|---|---|
| 57 | NC0111959 | 3 | 117.6 | 0.041178 | -0.01013 | GT | Study 1 | CV014 | 71 | 424 |
| 57 | NC0111959 | 3 | 117.6 | 0.016177 | -0.01609 | GT | Study 1 | CV077 | 71 | 424 |
| 57 | NC0023890 | 3 | 119.5 | 3.39E-13 | 0.207322 | C | Study 2 | -- | 121 | 425 |
| 57 | NC0023890 | 3 | 119.5 | 0.000871 | -0.20028 | T | Study 1 | CV041 | 121 | 425 |
| 57 | NC0023890 | 3 | 119.5 | 0 | 0.267461 | T | Study 1 | CV149 | 121 | 425 |
| 58 | NC0106349 | 3 | 120.6 | -- | -- | G | Study 4 | -- | 129 | 426 |
| 58 | NC0106349 | 3 | 120.6 | -- | -- | G | Study 5 | -- | 129 | 426 |
| 58 | NC0106349 | 3 | 120.6 | 0.0074 | 0.06561 | G | Study 1 | CV168 | 129 | 426 |
| 58 | NC0106349 | 3 | 120.6 | 0.008712 | 0.118081 | G | Study 1 | CV118 | 129 | 426 |
| 58 | NC0106349 | 3 | 120.6 | 0.000096 | -0.15328 | G | Study 1 | CV101 | 129 | 426 |
| 58 | NC0106349 | 3 | 120.6 | 0.000001 | 0.138245 | G | Study 1 | CV150 | 129 | 426 |
| 58 | NC0106349 | 3 | 120.6 | 0 | 0.193598 | G | Study 1 | CV150 | 129 | 426 |
| 58 | NC0106349 | 3 | 120.6 | 0.003731 | 0.018712 | A | Study 1 | CV014 | 129 | 426 |
| 58 | NC0199918 | 3 | 121.1 | -- | -- | T | Study 5 | -- | 319 | 427 |
| 58 | NC0000399 | 3 | 123.9 | -- | -- | G | Study 5 | -- | 275 | 428 |
| 58 | NC0002905 | 3 | 123.9 | -- | -- | T | Study 4 | -- | 98 | 429 |
| 58 | NC0002905 | 3 | 123.9 | 0.047891 | -0.04422 | A | Study 1 | CV082 | 98 | 429 |
| 58 | NC0002905 | 3 | 123.9 | 0.000002 | 0.420946 | T | Study 1 | CV161 | 98 | 429 |
| 58 | NC0009173 | 3 | 124.2 | 0.017251 | -0.09376 | A | Study 1 | CV041 | 101 | 430 |
| 58 | NC0011320 | 3 | 124.2 | 0.000011 | 0.224683 | C | Study 1 | CV125 | 65 | 431 |
| 58 | NC0144788 | 3 | 125.7 | 0.013531 | -0.04394 | G | Study 1 | CV010 | 485 | 432 |
| 58 | NC0144788 | 3 | 125.7 | 0.026704 | -0.16673 | A | Study 1 | I294213 | 485 | 432 |
| 58 | NC0008922 | 3 | 128.2 | -- | -- | G | Study 5 | -- | 271 | 433 |
| 58 | NC0008922 | 3 | 128.2 | 0.000012 | 0.23008 | G | Study 1 | CV149 | 271 | 433 |
| 58 | NC0008922 | 3 | 128.2 | 0.00598 | 0.097424 | A | Study 1 | CV079 | 271 | 433 |
| 58 | NC0008922 | 3 | 128.2 | 0.000052 | 0.156766 | A | Study 1 | CV079 | 271 | 433 |
| 59 | NC0040232 | 3 | 139.8 | -- | -- | T | Study 4 | -- | 69 | 434 |
| 59 | NC0031450 | 3 | 139.9 | 0.000093 | 0.194748 | C | Study 1 | CV125 | 262 | 435 |
| 59 | NC0031450 | 3 | 139.9 | 0.00568 | 0.020454 | C | Study 1 | CV150 | 262 | 435 |
| 60 | NC0015965 | 3 | 140.8 | 1.14E-10 | 0.18974 | T | Study 2 | -- | 281 | 436 |
| 60 | NC0015954 | 3 | 141 | -- | -- | T | Study 4 | -- | 254 | 437 |
| 60 | NC0015954 | 3 | 141 | 0.000985 | 0.136399 | T | Study 1 | CV116 | 254 | 437 |
| 60 | NC0015954 | 3 | 141 | 0.027735 | -0.13626 | A | Study 1 | CV041 | 254 | 437 |

CONT.

| QTL | Marker | Chr | pos | sig | effect | res allele | Mapping Study | Fav. Parent | SNP Position | SEQ ID |
|---|---|---|---|---|---|---|---|---|---|---|
| 60 | NC0015954 | 3 | 141 | 0.01645 | 0.026942 | T | Study 1 | CV165 | 254 | 437 |
| 60 | NC0015954 | 3 | 141 | 0.002105 | 0.029906 | T | Study 1 | CV165 | 254 | 437 |
| 60 | NC0015954 | 3 | 141 | 0.016574 | 0.015554 | T | Study 1 | CV169 | 254 | 437 |
| 60 | NC0034494 | 3 | 141 | 0.009469 | 0.013891 | G | Study 1 | CV006 | 524 | 438 |
| 60 | NC0034494 | 3 | 141 | 0.038421 | 0.024646 | A | Study 1 | CV155 | 524 | 438 |
| 60 | NC0039763 | 3 | 145.4 | 0.015968 | 0.006325 | G | Study 1 | CV141 | 192 | 439 |
| 60 | NC0041040 | 3 | 145.4 | 0.006596 | -0.05752 | A | Study 1 | CV082 | 497 | 440 |
| 60 | NC0041040 | 3 | 145.4 | 0.032235 | -0.01237 | G | Study 1 | CV025 | 497 | 440 |
| 60 | NC0041040 | 3 | 145.4 | 0.008576 | 0.076944 | G | Study 1 | CV150 | 497 | 440 |
| 60 | NC0041040 | 3 | 145.4 | 0.000001 | 0.157504 | G | Study 1 | CV150 | 497 | 440 |
| 60 | NC0077118 | 3 | 145.9 | -- | -- | G | Study 5 | -- | 188 | 441 |
| 60 | NC0077118 | 3 | 145.9 | 0.020119 | 0.097199 | A | Study 1 | CV116 | 188 | 441 |
| 60 | NC0077118 | 3 | 145.9 | 0.031045 | 0.011062 | G | Study 1 | I283669 | 188 | 441 |
| 60 | NC0077118 | 3 | 145.9 | 0.000001 | 0.203923 | A | Study 1 | CV118 | 188 | 441 |
| 60 | NC0015865 | 3 | 147.5 | 0.000248 | 0.195379 | A | Study 1 | CV149 | 399 | 442 |
| 60 | NC0004013 | 3 | 148.1 | 0.006919 | -0.015541 | T | Study 1 | CV076 | 276 | 443 |
| 60 | NC0036695 | 3 | 148.1 | 0.007457 | -0.23208 | C | Study 1 | I294213 | 243 | 444 |
| 60 | NC0036695 | 3 | 148.1 | 0.004184 | 0.101278 | G | Study 1 | CV079 | 243 | 444 |
| 60 | NC0036695 | 3 | 148.1 | 0.000991 | 0.12846 | G | Study 1 | CV079 | 243 | 444 |
| 60 | NC0017494 | 3 | 148.4 | 0.003883 | 0.173373 | G | Study 1 | CV160 | 294 | 445 |
| 60 | NC0199759 | 3 | 149 | -- | -- | G | Study 5 | -- | 288 | 446 |
| 60 | NC0110128 | 3 | 149.5 | 0.046589 | -0.00519 | * | Study 1 | CV056 | 217 | 447 |
| 60 | NC0172191 | 3 | 149.5 | -- | -- | T | Study 5 | -- | 153 | 448 |
| 60 | NC0173461 | 3 | 149.5 | -- | -- | C | Study 5 | -- | 179 | 449 |
| 61 | NC0043810 | 3 | 151.9 | 0.000344 | 0.021577 | G | Study 1 | CV141 | 424 | 450 |
| 61 | NC0029390 | 3 | 152.7 | <.0001 | 0.149859 | T | Study 3 | -- | 300 | 451 |
| 61 | NC0029390 | 3 | 152.7 | 1.68E-12 | 0.202054 | C | Study 2 | -- | 300 | 451 |
| 61 | NC0029390 | 3 | 152.7 | 0.044939 | 0.033514 | T | Study 1 | CV114 | 300 | 451 |
| 61 | NC0029390 | 3 | 152.7 | 0.002353 | -0.02018 | T | Study 1 | CV077 | 300 | 451 |
| 61 | NC0029390 | 3 | 152.7 | 0.028366 | 0.013926 | C | Study 1 | CV169 | 300 | 451 |
| 61 | NC0199913 | 3 | 152.8 | -- | -- | T | Study 5 | -- | 52 | 452 |
| 61 | NC0021772 | 3 | 154.1 | 0.00695 | 0.0315 | T | Study 1 | CV155 | 259 | 453 |
| 61 | NC0021772 | 3 | 154.1 | 0.049332 | 0.181964 | C | Study 1 | CV161 | 259 | 453 |

CONT.

| QTL | Marker | Chr | pos | sig | effect | res allele | Mapping Study | Fav. Parent | SNP Position | SEQ ID |
|---|---|---|---|---|---|---|---|---|---|---|
| 61 | NC0105966 | 3 | 154.6 | 0.006876 | -0.02704 | G | Study 1 | CV146 | 343 | 454 |
| 61 | NC0146188 | 3 | 154.6 | 0.046943 | 0.009359 | T | Study 1 | I283669 | 93 | 455 |
| 61 | NC0199682 | 3 | 155.2 | -- | -- | T | Study 5 | -- | 173 | 456 |
| 61 | NC0054742 | 3 | 155.3 | -- | -- | T | Study 4 | -- | 130 | 457 |
| 61 | NC0054742 | 3 | 155.3 | 0.020843 | 0.022705 | T | Study 1 | CV135 | 130 | 457 |
| 61 | NC0054742 | 3 | 155.3 | 0.001711 | -0.23349 | C | Study 1 | I294213 | 130 | 457 |
| 61 | NC0173894 | 3 | 156.5 | -- | -- | G | Study 5 | -- | 560 | 458 |
| 62 | NC0143174 | 3 | 161.4 | 0.048351 | 0.004714 | G | Study 1 | CV051 | 424 | 459 |
| 62 | NC0071496 | 3 | 161.7 | 0.016943 | -0.00743 | G | Study 1 | CV122 | 139 | 460 |
| 62 | NC0108630 | 3 | 163.5 | 0.0029 | 0.105606 | G | Study 3 | -- | 341 | 461 |
| 62 | NC0108630 | 3 | 163.5 | 1.28E-07 | 0.175183 | G | Study 2 | -- | 341 | 461 |
| 62 | NC0108630 | 3 | 163.5 | 0.045265 | -0.01754 | A | Study 1 | I294213 | 341 | 461 |
| 62 | NC0108630 | 3 | 163.5 | 0.042807 | 0.016734 | C | Study 1 | CV165 | 341 | 461 |
| 62 | NC0004371 | 3 | 164.2 | 0.029475 | -0.00544 | G | Study 1 | CV056 | 322 | 462 |
| 62 | NC0004371 | 3 | 164.2 | 0.041613 | 0.009252 | G | Study 1 | I283669 | 322 | 462 |
| 62 | NC0004371 | 3 | 164.2 | 0.006977 | 0.006361 | G | Study 1 | CV051 | 322 | 462 |
| 62 | NC0004371 | 3 | 164.2 | 0.012755 | 0.027809 | G | Study 1 | CV165 | 322 | 462 |
| 62 | NC0004371 | 3 | 164.2 | 0.00674 | 0.026295 | G | Study 1 | CV165 | 322 | 462 |
| 62 | NC0151375 | 3 | 166.4 | 0.000164 | 0.193168 | T | Study 1 | CV125 | 471 | 463 |
| 62 | NC0009473 | 3 | 168.4 | 0.037328 | -0.04482 | C | Study 1 | CV082 | 336 | 464 |
| 62 | NC0009473 | 3 | 168.4 | 0.03867 | -0.12688 | T | Study 1 | CV025 | 336 | 464 |
| 62 | NC0009473 | 3 | 168.4 | 0.002134 | 0.130502 | C | Study 1 | CV125 | 336 | 464 |
| 62 | NC0009473 | 3 | 168.4 | 0.005921 | -0.01616 | T | Study 1 | CV025 | 336 | 464 |
| 63 | NC0031216 | 3 | 171.3 | -- | -- | G | Study 5 | -- | 195 | 465 |
| 63 | NC0189460 | 3 | 171.8 | -- | -- | T | Study 5 | -- | 531 | 466 |
| 63 | NC0105852 | 3 | 176.4 | 0.011254 | 0.158482 | C | Study 1 | CV160 | 258 | 467 |
| 63 | NC0110780 | 3 | 176.8 | 0.021774 | 0.225985 | A | Study 1 | CV161 | 360 | 468 |
| 63 | NC0110780 | 3 | 176.8 | 0.047201 | 0.070840 | A | Study 1 | CV079 | 360 | 468 |
| 63 | NC0110780 | 3 | 176.8 | 0.00556 | 0.109819 | A | Study 1 | CV079 | 360 | 468 |
| 63 | NC0055817 | 3 | 177.1 | -- | -- | T | Study 4 | -- | 308 | 469 |
| 63 | NC0055817 | 3 | 177.1 | 0.013149 | 0.150169 | T | Study 1 | CV006 | 308 | 469 |
| 63 | NC0055817 | 3 | 177.1 | 0.004291 | -0.06239 | G | Study 1 | CV082 | 308 | 469 |
| 63 | NC0055817 | 3 | 177.1 | 0.000048 | 0.17472 | G | Study 1 | CV118 | 308 | 469 |

CONT.

| QTL | Marker | Chr | pos | sig | effect | res allele | Mapping Study | Fav. Parent | SNP Position | SEQ ID |
|---|---|---|---|---|---|---|---|---|---|---|
| 63 | NC0055817 | 3 | 177.1 | 0.006013 | -0.13167 | G | Study 1 | I294213 | 308 | 469 |
| 63 | NC0055817 | 3 | 177.1 | 0.026369 | 0.017815 | G | Study 1 | CV165 | 308 | 469 |
| 63 | NC0055817 | 3 | 177.1 | 0.013017 | 0.015384 | G | Study 1 | CV141 | 308 | 469 |
| 63 | NC0106901 | 3 | 177.6 | 0.000122 | 0.195613 | T | Study 1 | CV125 | 282 | 470 |
| 63 | NC0030587 | 3 | 179.7 | 0.000141 | 0.095721 | C | Study 1 | CV168 | 76 | 471 |
| 63 | NC0030587 | 3 | 179.7 | 0.000641 | -0.01911 | C | Study 1 | CV040 | 76 | 471 |
| 63 | NC0030587 | 3 | 179.7 | 0.006872 | 0.079336 | A | Study 1 | CV150 | 76 | 471 |
| 63 | NC0030587 | 3 | 179.7 | 0.009071 | 0.086362 | A | Study 1 | CV150 | 76 | 471 |
| 63 | NC0030587 | 3 | 179.7 | 0.008289 | -0.01655 | C | Study 1 | CV077 | 76 | 471 |
| 63 | NC0030587 | 3 | 179.7 | 0.000736 | -0.01592 | C | Study 1 | I294213 | 76 | 471 |
| 64 | NC0112644 | 3 | 181.8 | 1.51E-09 | 0.173132 | C | Study 2 | -- | 405 | 472 |
| 64 | NC0112644 | 3 | 181.8 | 0.049167 | -0.01889 | T | Study 1 | CV146 | 405 | 472 |
| 64 | NC0112644 | 3 | 181.8 | 0.049934 | -0.00526 | C | Study 1 | CV056 | 405 | 472 |
| 64 | NC0112644 | 3 | 181.8 | 0.000759 | 0.086986 | T | Study 1 | CV168 | 405 | 472 |
| 64 | NC0112644 | 3 | 181.8 | 0.006845 | -0.1317 | T | Study 1 | I294213 | 405 | 472 |
| 64 | NC0112644 | 3 | 181.8 | 0.04122 | 0.008138 | T | Study 1 | CV101 | 405 | 472 |
| 64 | NC0112644 | 3 | 181.8 | 0.017278 | 0.005197 | T | Study 1 | CV051 | 405 | 472 |
| 64 | NC0112644 | 3 | 181.8 | 0.041063 | 0.109622 | T | Study 1 | CV149 | 405 | 472 |
| 64 | NC0112644 | 3 | 181.8 | 0.0378 | -0.15001 | C | Study 1 | I294213 | 405 | 472 |
| 64 | NC0112644 | 3 | 181.8 | 0.03852 | 0.014961 | T | Study 1 | CV074 | 405 | 472 |
| 64 | NC0112644 | 3 | 181.8 | 0.000639 | -0.01903 | C | Study 1 | CV040 | 405 | 472 |
| 64 | NC0112644 | 3 | 181.8 | 0.045091 | 0.010415 | T | Study 1 | CV153 | 405 | 472 |
| 64 | NC0112644 | 3 | 181.8 | 0.004908 | 0.111484 | C | Study 1 | CV079 | 405 | 472 |
| 64 | NC0112644 | 3 | 181.8 | 0.000107 | -0.01837 | T | Study 1 | I294213 | 405 | 472 |
| 64 | NC0112487 | 3 | 182.9 | 0.0004 | 0.35796 | G | Study 3 | -- | 88 | 473 |
| 64 | NC0112491 | 3 | 182.9 | <.0001 | -0.4002 | C | Study 3 | -- | 90 | 474 |
| 64 | NC0112491 | 3 | 182.9 | 0.016096 | 0.150226 | G | Study 1 | CV006 | 90 | 474 |
| 64 | NC0112491 | 3 | 182.9 | 0.000275 | 0.154988 | C | Study 1 | CV125 | 90 | 474 |
| 64 | NC0112491 | 3 | 182.9 | 0.0419 | 0.020066 | C | Study 1 | CV135 | 90 | 474 |
| 64 | NC0112491 | 3 | 182.9 | 0.034762 | 0.02606 | C | Study 1 | CV155 | 90 | 474 |
| 64 | NC0112491 | 3 | 182.9 | 0.011429 | -0.01448 | G | Study 1 | CV025 | 90 | 474 |
| 64 | NC0056939 | 3 | 183.6 | -- | -- | C | Study 4 | -- | 426 | 475 |
| 64 | NC0056939 | 3 | 183.6 | -- | -- | C | Study 5 | -- | 426 | 475 |

CONT.

| QTL | Marker | Chr | pos | sig | effect | res allele | Mapping Study | Fav. Parent | SNP Position | SEQ ID |
|---|---|---|---|---|---|---|---|---|---|---|
| 64 | NC0056939 | 3 | 183.6 | 0.000334 | 0.018566 | C | Study 1 | CV005 | 426 | 475 |
| 64 | NC0146534 | 3 | 183.6 | -- | -- | T | Study 4 | -- | 91 | 476 |
| 64 | NC0032026 | 3 | 183.9 | 0.02923 | 0.017555 | A | Study 1 | CV165 | 1134 | 477 |
| 64 | NC0154169 | 3 | 184.3 | -- | -- | T | Study 5 | -- | 74 | 478 |
| 64 | NC0146497 | 3 | 187.4 | -- | -- | T | Study 4 | -- | 98 | 479 |
| 64 | NC0146497 | 3 | 187.4 | 0.026386 | 0.056639 | T | Study 1 | CV168 | 98 | 479 |
| 64 | NC0146497 | 3 | 187.4 | 0.00657 | -0.01322 | T | Study 1 | I294213 | 98 | 479 |
| 64 | NC0155987 | 3 | 187.4 | -- | -- | T | Study 4 | -- | 1001 | 480 |
| 64 | NC0028145 | 3 | 187.5 | 0.041608 | -0.00896 | A | Study 1 | CV013 | 307 | 481 |
| 64 | NC0028145 | 3 | 187.5 | 0.000738 | 0.173307 | G | Study 1 | CV125 | 307 | 481 |
| 64 | NC0143969 | 3 | 187.5 | -- | -- | * | Study 4 | -- | 100 | 482 |
| 64 | NC0143969 | 3 | 187.5 | 0.041078 | 0.010947 | TA | Study 1 | CV006 | 100 | 482 |
| 64 | NC0143969 | 3 | 187.5 | 0.013828 | 0.014034 | * | Study 1 | CV141 | 100 | 482 |
| 64 | NC0143969 | 3 | 187.5 | 0.004572 | 0.165388 | * | Study 1 | CV160 | 100 | 482 |
| 64 | NC0143969 | 3 | 187.5 | 0.000698 | 0.037604 | * | Study 1 | CV165 | 100 | 482 |
| 64 | NC0143969 | 3 | 187.5 | 0.000075 | 0.038026 | * | Study 1 | CV165 | 100 | 482 |
| 65 | NC0078580 | 3 | 193.9 | -- | -- | G | Study 5 | -- | 101 | 483 |
| 65 | NC0009079 | 3 | 194.2 | 0.002594 | 0.128482 | C | Study 1 | CV125 | 118 | 484 |
| 65 | NC0009079 | 3 | 194.2 | 0.041104 | -0.00663 | C | Study 1 | CV089 | 118 | 484 |
| 65 | NC0110756 | 3 | 197.4 | 0.002033 | 0.112545 | T | Study 1 | CV053 | 136 | 485 |
| 65 | NC0110756 | 3 | 197.4 | 0.025362 | 0.068343 | G | Study 1 | CV150 | 136 | 485 |
| 65 | NC0010232 | 3 | 198.7 | 0.000002 | 0.199858 | T | Study 1 | CV118 | 353 | 486 |
| 65 | NC0010232 | 3 | 198.7 | 0.017304 | 0.128863 | C | Study 1 | CV149 | 353 | 486 |
| 65 | NC0010232 | 3 | 198.7 | 0.000512 | -0.01962 | T | Study 1 | CV025 | 353 | 486 |
| 66 | NC0000055 | 3 | 201.1 | 0.0035 | 0.106003 | T | Study 3 | -- | 97 | 487 |
| 66 | NC0190645 | 3 | 202.4 | -- | -- | A | Study 5 | -- | 90 | 488 |
| 66 | NC0019414 | 3 | 204.2 | 0.004755 | 0.08091 | A | Study 2 | -- | 272 | 489 |
| 66 | NC0019414 | 3 | 204.2 | 0.034246 | -0.09432 | C | Study 1 | I294213 | 272 | 489 |
| 66 | NC0019414 | 3 | 204.2 | 0.016056 | 0.005313 | C | Study 1 | CV051 | 272 | 489 |
| 66 | NC0019414 | 3 | 204.2 | 0.023807 | 0.058043 | A | Study 1 | CV116 | 272 | 489 |
| 66 | NC0019414 | 3 | 204.2 | 0.000007 | 0.18987 | A | Study 1 | CV118 | 272 | 489 |
| 66 | NC0019414 | 3 | 204.2 | 0.002848 | 0.154485 | A | Study 1 | CV125 | 272 | 489 |
| 66 | NC0019414 | 3 | 204.2 | 0.001511 | -0.00978 | C | Study 1 | CV138 | 272 | 489 |

CONT.

| QTL | Marker | Chr | pos | sig | effect | res allele | Mapping Study | Fav. Parent | SNP Position | SEQ ID |
|---|---|---|---|---|---|---|---|---|---|---|
| 66 | NC0019414 | 3 | 204.2 | 0.00451 | 0.0317 | C | Study 1 | CV165 | 272 | 489 |
| 66 | NC0019414 | 3 | 204.2 | 0.001903 | 0.030133 | C | Study 1 | CV165 | 272 | 489 |
| 66 | NC0019414 | 3 | 204.2 | 0.006783 | -0.01418 | C | Study 1 | I294213 | 272 | 489 |
| 66 | NC0003970 | 3 | 208 | -- | -- | G | Study 5 | -- | 355 | 490 |
| 66 | NC0003970 | 3 | 208 | 0.008295 | -0.06615 | G | Study 1 | CV052 | 355 | 490 |
| 66 | NC0003970 | 3 | 208 | 0.021301 | -0.00716 | G | Study 1 | CV052 | 355 | 490 |
| 66 | NC0003970 | 3 | 208 | 0.018829 | 0.128122 | A | Study 1 | CV164 | 355 | 490 |
| 67 | NC0173736 | 3 | 211 | -- | -- | T | Study 5 | -- | 1001 | 491 |
| 67 | NC0104796 | 3 | 212.1 | 0.005392 | 0.15223 | * | Study 1 | CV164 | 170 | 492 |
| 67 | NC0014041 | 3 | 217.6 | 0.00015 | 0.161921 | A | Study 1 | CV118 | 244 | 493 |
| 67 | NC0014041 | 3 | 217.6 | 0.045158 | -0.07707 | C | Study 1 | CV075 | 244 | 493 |
| 67 | NC0078117 | 3 | 218.2 | -- | -- | T | Study 5 | -- | 215 | 494 |
| 67 | NC0077802 | 3 | 218.7 | 0.043396 | -0.00382 | T | Study 1 | I294213 | 201 | 495 |
| 67 | NC0077802 | 3 | 218.7 | 0.001471 | 0.173706 | G | Study 1 | CV069 | 201 | 495 |
| 67 | NC0077802 | 3 | 218.7 | 0.028323 | 0.017448 | G | Study 1 | CV165 | 201 | 495 |
| 67 | NC0077802 | 3 | 218.7 | 0.024716 | -0.00948 | G | Study 1 | CV095 | 201 | 495 |
| 67 | NC0077802 | 3 | 218.7 | 0.016096 | 0.016356 | T | Study 1 | CV014 | 201 | 495 |
| 68 | NC0012340 | 4 | 0.5 | 0.004643 | 0.02089 | T | Study 1 | CV065 | 402 | 496 |
| 68 | NC0012340 | 4 | 0.5 | 0.035087 | -0.13142 | T | Study 1 | CV017 | 402 | 496 |
| 68 | NC0012340 | 4 | 0.5 | 0.000525 | -0.01052 | T | Study 1 | CV138 | 402 | 496 |
| 68 | NC0012340 | 4 | 0.5 | 0.04694 | 0.016733 | A | Study 1 | CV123 | 402 | 496 |
| 68 | NC0012340 | 4 | 0.5 | 0.009471 | 0.021847 | T | Study 1 | CV069 | 402 | 496 |
| 68 | NC0012340 | 4 | 0.5 | 0.043296 | 0.013107 | A | Study 1 | CV169 | 402 | 496 |
| 68 | NC0009523 | 4 | 0.9 | 0.004246 | 0.020865 | T | Study 1 | CV065 | 434 | 497 |
| 68 | NC0009523 | 4 | 0.9 | 0.001281 | 0.004146 | A | Study 1 | CV006 | 434 | 497 |
| 68 | NC0009523 | 4 | 0.9 | 0.001281 | 0.004146 | A | Study 1 | CV006 | 434 | 497 |
| 68 | NC0009523 | 4 | 0.9 | 0.038904 | -0.03768 | T | Study 1 | CV041 | 434 | 497 |
| 68 | NC0009523 | 4 | 0.9 | 0.029006 | -0.02262 | T | Study 1 | I294213 | 434 | 497 |
| 68 | NC0009523 | 4 | 0.9 | 0.013272 | 0.009077 | A | Study 1 | CV151 | 434 | 497 |
| 68 | NC0055502 | 4 | 1.8 | 0.027298 | 0.208359 | T | Study 1 | CV109 | 105 | 498 |
| 68 | NC0055502 | 4 | 1.8 | 0.006668 | 0.012615 | C | Study 1 | CV081 | 105 | 498 |
| 68 | NC0055502 | 4 | 1.8 | 0.005363 | 0.022763 | T | Study 1 | CV069 | 105 | 498 |
| 68 | NC0196391 | 4 | 6.9 | -- | -- | C | Study 5 | -- | 234 | 499 |

CONT.

| QTL | Marker | Chr | pos | sig | effect | res allele | Mapping Study | Fav. Parent | SNP Position | SEQ ID |
|---|---|---|---|---|---|---|---|---|---|---|
| 69 | NC0002739 | 4 | 11.8 | -- | -- | * | Study 4 | -- | 126 | 500 |
| 69 | NC0002739 | 4 | 11.8 | 0.024075 | -0.01232 | * | Study 1 | CV136 | 126 | 500 |
| 69 | NC0199824 | 4 | 13.6 | -- | -- | -- | Study 5 | -- | 357 | 501 |
| 69 | NC0038222 | 4 | 17.6 | -- | -- | -- | Study 5 | -- | 95 | 502 |
| 70 | NC0009057 | 4 | 21.7 | -- | -- | T | Study 5 | -- | 246 | 503 |
| 70 | NC0009057 | 4 | 21.7 | 0.027692 | 0.014397 | G | Study 1 | CV011 | 246 | 503 |
| 70 | NC0009057 | 4 | 21.7 | 0.00979 | 0.11185 | T | Study 1 | CV125 | 246 | 503 |
| 70 | NC0009057 | 4 | 21.7 | 0.008145 | 0.028865 | T | Study 1 | CV154 | 246 | 503 |
| 70 | NC0009057 | 4 | 21.7 | 0.00085 | -0.0217 | G | Study 1 | CV025 | 246 | 503 |
| 70 | NC0009057 | 4 | 21.7 | 0.007821 | 0.156292 | G | Study 1 | CV070 | 246 | 503 |
| 70 | NC0009057 | 4 | 21.7 | 0.039053 | 0.012332 | G | Study 1 | CV079 | 246 | 503 |
| 70 | NC0009057 | 4 | 21.7 | 0.024997 | 0.190896 | G | Study 1 | CV130 | 246 | 503 |
| 70 | NC0009057 | 4 | 21.7 | 0.022272 | 0.014909 | T | Study 1 | CV147 | 246 | 503 |
| 70 | NC0069221 | 4 | 21.9 | 0.006917 | -0.0078 | C | Study 1 | CV138 | 170 | 504 |
| 71 | NC0105666 | 4 | 30.4 | <.0001 | -0.42472 | A | Study 3 | -- | 230 | 505 |
| 71 | NC0105666 | 4 | 30.4 | 0.000843 | 0.02179 | C | Study 1 | CV011 | 230 | 505 |
| 71 | NC0105666 | 4 | 30.4 | 0.002264 | -0.00858 | C | Study 1 | CV138 | 230 | 505 |
| 71 | NC0105666 | 4 | 30.4 | 0.016577 | -0.29806 | C | Study 1 | CV130 | 230 | 505 |
| 71 | NC0105666 | 4 | 30.4 | 0.015991 | 0.213218 | C | Study 1 | CV160 | 230 | 505 |
| 71 | NC0105666 | 4 | 30.4 | 0.01461 | 0.143989 | C | Study 2 | -- | 230 | 505 |
| 71 | NC0110069 | 4 | 34.4 | 0.022632 | -0.06511 | G | Study 1 | CV052 | 314 | 506 |
| 71 | NC0110069 | 4 | 34.4 | 0.031511 | -0.0061 | G | Study 1 | CV154 | 314 | 506 |
| 71 | NC0110069 | 4 | 34.4 | 0.002947 | 0.032316 | G | Study 1 | CV025 | 314 | 506 |
| 71 | NC0110069 | 4 | 34.4 | 0.002926 | -0.01965 | A | Study 1 | CV071 | 314 | 506 |
| 71 | NC0110069 | 4 | 34.4 | 0.035906 | -0.20041 | A | Study 1 | -- | 314 | 506 |
| 71 | NC0111464 | 4 | 34.4 | -- | -- | G | Study 5 | -- | 115 | 507 |
| 71 | NC0111464 | 4 | 34.4 | 0.045859 | -0.03549 | A | Study 1 | CV070 | 115 | 507 |
| 71 | NC0111464 | 4 | 34.4 | 0.000008 | 0.258744 | A | Study 1 | CV070 | 115 | 507 |
| 71 | NC0111464 | 4 | 34.4 | 0.001513 | 0.024966 | G | Study 1 | CV123 | 115 | 507 |
| 72 | NC0018996 | 4 | 44.7 | 0.000047 | 0.025966 | T | Study 1 | CV011 | 213 | 508 |
| 72 | NC0018996 | 4 | 44.7 | 0.006872 | 0.164755 | C | Study 1 | CV160 | 213 | 508 |
| 72 | NC0019003 | 4 | 45.3 | 0.003694 | -0.05704 | G | Study 1 | CV042 | 405 | 509 |
| 72 | NC0034133 | 4 | 49.8 | 0.014484 | -0.14086 | C | Study 1 | CV131 | 202 | 510 |

CONT.

| QTL | Marker | Chr | pos | sig | effect | res allele | Mapping Study | Fav. Parent | SNP Position | SEQ ID |
|---|---|---|---|---|---|---|---|---|---|---|
| 72 | NC0034133 | 4 | 49.8 | 0.000598 | -0.01869 | C | Study 1 | CV087 | 202 | 510 |
| 72 | NC0034130 | 4 | 49.9 | 0.027918 | 0.114854 | G | Study 1 | CV023 | 126 | 511 |
| 72 | NC0034130 | 4 | 49.9 | 0 | -0.21546 | C | Study 1 | CV041 | 126 | 511 |
| 72 | NC0034130 | 4 | 49.9 | 0.003561 | 0.24835 | G | Study 1 | CV127 | 126 | 511 |
| 72 | NC0034130 | 4 | 49.9 | 0.030074 | -0.01308 | G | Study 1 | CV076 | 126 | 511 |
| 72 | NC0077263 | 4 | 50.6 | 0.000001 | 0.030515 | A | Study 1 | CV011 | 228 | 512 |
| 73 | NC0024647 | 4 | 52.5 | 0.000006 | 0.029084 | A | Study 1 | CV011 | 191 | 513 |
| 73 | NC0024647 | 4 | 52.5 | 0.004513 | 0.046544 | A | Study 1 | CV100 | 191 | 513 |
| 73 | NC0024647 | 4 | 52.5 | 0.006209 | 0.01105 | A | Study 1 | CV100 | 191 | 513 |
| 73 | NC0024647 | 4 | 52.5 | 0.000519 | 0.14485 | G | Study 1 | CV166 | 191 | 513 |
| 73 | NC0024647 | 4 | 52.5 | 0.000286 | 0.282003 | G | Study 1 | CV132 | 191 | 513 |
| 73 | NC0024647 | 4 | 52.5 | 0.000185 | 0.276161 | G | Study 1 | CV163 | 191 | 513 |
| 73 | NC0024647 | 4 | 52.5 | 0.041063 | -0.02025 | A | Study 1 | 1294213 | 191 | 513 |
| 73 | NC0024647 | 4 | 52.5 | 0.001965 | -0.00892 | A | Study 1 | CV138 | 191 | 513 |
| 73 | NC0024647 | 4 | 52.5 | 0.000005 | 0.036004 | A | Study 1 | CV123 | 191 | 513 |
| 73 | NC0009197 | 4 | 59.7 | 0.000001 | 0.031688 | * | Study 1 | CV011 | 478 | 514 |
| 73 | NC0037062 | 4 | 59.7 | 0.016846 | 0.010055 | C | Study 1 | CV170 | 52 | 515 |
| 73 | NC0037062 | 4 | 59.7 | 0.005364 | 0.008903 | C | Study 1 | CV101 | 52 | 515 |
| 73 | NC0037062 | 4 | 59.7 | 0 | 0.314486 | C | Study 1 | CV070 | 52 | 515 |
| 73 | NC0037062 | 4 | 59.7 | 0.037626 | 0.011228 | C | Study 1 | CV142 | 52 | 515 |
| 73 | NC0037062 | 4 | 59.7 | 0.000001 | -0.63909 | G | Study 1 | CV130 | 52 | 515 |
| 73 | NC0037062 | 4 | 59.7 | 0.037295 | 0.017575 | C | Study 1 | CV069 | 52 | 515 |
| 74 | NC0001122 | 4 | 61.4 | 0.000001 | 0.031688 | T | Study 1 | CV011 | 216 | 516 |
| 74 | NC0001122 | 4 | 61.4 | 0.008388 | -0.1922 | T | Study 1 | CV069 | 216 | 516 |
| 74 | NC0001122 | 4 | 61.4 | 0.033195 | -0.03761 | T | Study 1 | CV070 | 216 | 516 |
| 74 | NC0001122 | 4 | 61.4 | 0.000044 | -0.02616 | C | Study 1 | CV025 | 216 | 516 |
| 74 | NC0001122 | 4 | 61.4 | 0.008625 | 0.113033 | C | Study 1 | CV125 | 216 | 516 |
| 74 | NC0001122 | 4 | 61.4 | 0.017042 | 0.069075 | C | Study 1 | CV128 | 216 | 516 |
| 74 | NC0001122 | 4 | 61.4 | 0.028821 | 0.012097 | T | Study 1 | CV142 | 216 | 516 |
| 74 | NC0001122 | 4 | 61.4 | 0.028663 | 0.132065 | T | Study 1 | CV160 | 216 | 516 |
| 74 | NC0001122 | 4 | 61.4 | 0.002926 | 0.020327 | T | Study 1 | CV014 | 216 | 516 |
| 74 | NC0012012 | 4 | 61.4 | 0.000003 | 0.033215 | C | Study 1 | CV011 | 129 | 517 |
| 74 | NC0012012 | 4 | 61.4 | 0.045524 | -0.01027 | T | Study 1 | CV053 | 129 | 517 |

CONT.

| QTL | Marker | Chr | pos | sig | effect | res allele | Mapping Study | Fav. Parent | SNP Position | SEQ ID |
|---|---|---|---|---|---|---|---|---|---|---|
| 74 | NC0012012 | 4 | 61.4 | 0.026059 | -0.0066 | T | Study 1 | CV052 | 129 | 517 |
| 74 | NC0012012 | 4 | 61.4 | 0.000056 | -0.06791 | C | Study 1 | CV010 | 129 | 517 |
| 74 | NC0034325 | 4 | 63.7 | 0.002976 | 0.016907 | G | Study 1 | CV142 | 191 | 518 |
| 74 | NC0069795 | 4 | 65.5 | <.0001 | 0.375641 | T | Study 3 | -- | 386 | 519 |
| 74 | NC0042575 | 4 | 65.9 | 0.004505 | -0.08253 | A | Study 2 | -- | 107 | 520 |
| 74 | NC0028441 | 4 | 67.1 | 0.014635 | -0.01675 | C | Study 1 | CV010 | 125 | 521 |
| 74 | NC0038855 | 4 | 67.1 | 0.021792 | 0.123036 | C | Study 1 | CV164 | 74 | 522 |
| 74 | NC0038855 | 4 | 67.1 | 0.02141 | 0.059848 | C | Study 1 | CV135 | 74 | 522 |
| 74 | NC0038855 | 4 | 67.1 | 0 | 0.620323 | C | Study 1 | CV130 | 74 | 522 |
| 74 | NC0040371 | 4 | 67.8 | -- | -- | C | Study 4 | -- | 201 | 523 |
| 74 | NC0040371 | 4 | 67.8 | 0.000004 | 0.250029 | A | Study 1 | CV069 | 201 | 523 |
| 74 | NC0040371 | 4 | 67.8 | 0.000002 | -0.09921 | A | Study 1 | CV042 | 201 | 523 |
| 74 | NC0070730 | 4 | 67.8 | -- | -- | G | Study 4 | -- | 324 | 524 |
| 74 | NC0010305 | 4 | 68.4 | 0.043563 | -0.00318 | T | Study 1 | CV010 | 228 | 525 |
| 74 | NC0010305 | 4 | 68.4 | 0.043563 | -0.00318 | T | Study 1 | CV010 | 228 | 525 |
| 74 | NC0010305 | 4 | 68.4 | 0.000544 | -0.05817 | C | Study 1 | CV010 | 228 | 525 |
| 74 | NC0035683 | 4 | 68.4 | <.0001 | -0.19803 | C | Study 3 | -- | 245 | 526 |
| 74 | NC0035683 | 4 | 68.6 | 0.001784 | -0.00911 | C | Study 1 | CV138 | 245 | 526 |
| 74 | NC0015567 | 4 | 69.3 | 0.001114 | 0.021868 | T | Study 1 | CV061 | 235 | 527 |
| 74 | NC0038900 | 4 | 69.3 | -- | -- | T | Study 4 | -- | 276 | 528 |
| 74 | NC0038900 | 4 | 69.3 | 0.000202 | -0.35178 | T | Study 1 | CV071 | 276 | 528 |
| 74 | NC0009603 | 4 | 69.5 | 0.016775 | 0.026869 | T | Study 1 | CV154 | 193 | 529 |
| 74 | NC0033483 | 4 | 69.5 | -- | -- | T | Study 4 | -- | 163 | 530 |
| 74 | NC0031791 | 4 | 70.1 | -- | -- | ********** | Study 4 | -- | 402 | 531 |
| 75 | NC0031791 | 4 | 70.1 | 0.040417 | 0.009536 | ********** | Study 1 | CV142 | 402 | 531 |
| 75 | NC0031791 | 4 | 70.1 | 0.045342 | -0.01281 | CAGTCCCAGCT | Study 1 | CV063 | 402 | 531 |
| 75 | NC0020481 | 4 | 71 | <.0001 | 0.217696 | T | Study 3 | -- | 118 | 532 |
| 75 | NC0020481 | 4 | 71 | 0.021492 | 0.116319 | A | Study 1 | CV023 | 118 | 532 |
| 75 | NC0020481 | 4 | 71 | 0.024509 | 0.064986 | T | Study 1 | CV128 | 118 | 532 |
| 75 | NC0020481 | 4 | 71 | 0.04558 | 0.017471 | T | Study 1 | CV158 | 118 | 532 |
| 75 | NC0020481 | 4 | 71 | 0.034415 | 0.018348 | T | Study 1 | CV162 | 118 | 532 |
| 75 | NC0108120 | 4 | 71.5 | 0.0006 | 0.18251 | T | Study 3 | -- | 401 | 533 |

CONT.

| QTL | Marker | Chr | pos | sig | effect | res allele | Mapping Study | Fav. Parent | SNP Position | SEQ ID |
|---|---|---|---|---|---|---|---|---|---|---|
| 75 | NC0108120 | 4 | 71.5 | 0 | -0.23926 | T | Study 1 | CV041 | 401 | 533 |
| 75 | NC0108120 | 4 | 71.5 | 0.025869 | -0.10649 | T | Study 1 | CV067 | 401 | 533 |
| 75 | NC0034464 | 4 | 73.5 | 0.000232 | -0.10599 | A | Study 2 | -- | 125 | 534 |
| 75 | NC0034464 | 4 | 73.5 | 0.000021 | 0.181414 | A | Study 1 | CV166 | 125 | 534 |
| 75 | NC0034464 | 4 | 73.5 | 0.001398 | 0.228654 | A | Study 1 | CV163 | 125 | 534 |
| 75 | NC0034464 | 4 | 73.5 | 0 | 0.433985 | A | Study 1 | CV070 | 125 | 534 |
| 75 | NC0034464 | 4 | 73.5 | 0.001495 | 0.018969 | A | Study 1 | CV079 | 125 | 534 |
| 75 | NC0034464 | 4 | 73.5 | 0 | 0.048971 | A | Study 1 | CV123 | 125 | 534 |
| 75 | NC0034464 | 4 | 73.5 | 0.004513 | 0.019348 | A | Study 1 | CV014 | 125 | 534 |
| 75 | NC0002585 | 4 | 74.4 | 0.048511 | -0.00597 | T | Study 1 | CV052 | 223 | 535 |
| 75 | NC0002585 | 4 | 74.4 | 0.013899 | 0.013512 | T | Study 1 | CV007 | 223 | 535 |
| 75 | NC0005451 | 4 | 74.8 | -- | -- | G | Study 4 | -- | 224 | 536 |
| 75 | NC0015096 | 4 | 74.8 | 0.001572 | 0.18765 | A | Study 1 | CV160 | 398 | 537 |
| 75 | NC0003351 | 4 | 76 | -- | -- | C | Study 4 | -- | 432 | 538 |
| 75 | NC0003351 | 4 | 76 | 0.005403 | -0.01552 | A | Study 1 | CV087 | 432 | 538 |
| 75 | NC0015247 | 4 | 76 | -- | -- | T | Study 4 | -- | 483 | 539 |
| 75 | NC0004924 | 4 | 76.3 | 0.000969 | -0.09708 | T | Study 2 | -- | 46 | 540 |
| 75 | NC0113163 | 4 | 76.3 | 0.030834 | -0.04893 | C | Study 1 | CV010 | 44 | 541 |
| 75 | NC0199812 | 4 | 77.3 | -- | -- | C | Study 5 | -- | 45 | 542 |
| 75 | NC0080778 | 4 | 77.7 | -- | -- | G | Study 4 | -- | 184 | 543 |
| 75 | NC0014666 | 4 | 77.8 | -- | -- | G | Study 4 | -- | 108 | 544 |
| 75 | NC0020374 | 4 | 77.8 | 0.00857 | -0.06576 | T | Study 1 | CV022 | 397 | 545 |
| 75 | NC0020374 | 4 | 77.8 | 0.045384 | 0.058115 | T | Study 1 | CV128 | 397 | 545 |
| 75 | NC0078135 | 4 | 77.8 | -- | -- | G | Study 4 | -- | 321 | 546 |
| 75 | NC0000415 | 4 | 78.9 | 0.002755 | 0.019343 | G | Study 1 | CV061 | 103 | 547 |
| 75 | NC0153429 | 4 | 78.9 | -- | -- | T | Study 5 | -- | 235 | 548 |
| 75 | NC0106099 | 4 | 79.8 | 0.000876 | 0.021299 | T | Study 1 | I283669 | 84 | 549 |
| 75 | NC0106099 | 4 | 79.8 | 0.000547 | -0.10136 | T | Study 5 | -- | 84 | 549 |
| 75 | NC0109551 | 4 | 79.8 | 0 | -0.78401 | G | Study 2 | -- | 100 | 550 |
| 75 | NC0151500 | 4 | 79.8 | <.0001 | 0.169377 | G | Study 1 | CV130 | 493 | 551 |
| 75 | NC0003532 | 4 | 81.3 | -- | -- | T | Study 3 | -- | 600 | 552 |
| 76 | NC0080475 | 4 | 82 | -- | -- | G | Study 5 | -- | 228 | 553 |
| 76 | NC0084527 | 4 | 82 | 0 | -0.44175 | C | Study 1 | CV069 | 509 | 554 |

CONT.

| QTL | Marker | Chr | pos | sig | effect | res allele | Mapping Study | Fav. Parent | SNP Position | SEQ ID |
|---|---|---|---|---|---|---|---|---|---|---|
| 76 | NC0084527 | 4 | 82 | 0.000002 | 0.398659 | C | Study 1 | CV127 | 509 | 554 |
| 76 | NC0084527 | 4 | 82 | 0.01718 | 0.022649 | C | Study 1 | CV127 | 509 | 554 |
| 76 | NC0084527 | 4 | 82 | 0.000048 | 0.315136 | C | Study 1 | CV132 | 509 | 554 |
| 76 | NC0084527 | 4 | 82 | 0.001524 | 0.037574 | C | Study 1 | CV132 | 509 | 554 |
| 76 | NC0084527 | 4 | 82 | 0.02648 | -0.007 | C | Study 1 | CV138 | 509 | 554 |
| 76 | NC0084527 | 4 | 82 | 0 | 0.02858 | C | Study 1 | CV142 | 509 | 554 |
| 76 | NC0084527 | 4 | 82 | 0.047041 | -0.05815 | A | Study 1 | CV119 | 509 | 554 |
| 76 | NC0084527 | 4 | 82 | 0.026658 | -0.07301 | A | Study 1 | CV119 | 509 | 554 |
| 76 | NC0084527 | 4 | 82 | 0.043382 | 0.012863 | A | Study 1 | CV147 | 509 | 554 |
| 76 | NC0111150 | 4 | 82 | 0.000007 | -0.02892 | T | Study 1 | CV025 | 449 | 555 |
| 76 | NC0027345 | 4 | 82.5 | 0.000361 | -0.10531 | A | Study 2 | -- | 237 | 556 |
| 76 | NC0027345 | 4 | 82.5 | 0.000119 | 0.162727 | G | Study 1 | CV125 | 237 | 556 |
| 76 | NC0027345 | 4 | 82.5 | 0.029972 | 0.279434 | G | Study 1 | CV167 | 237 | 556 |
| 76 | NC0027345 | 4 | 82.5 | 0.012365 | 0.021041 | G | Study 1 | CV158 | 237 | 556 |
| 76 | NC0027345 | 4 | 82.5 | 0.044648 | 0.02398 | G | Study 1 | CV058 | 237 | 556 |
| 76 | NC0027345 | 4 | 82.5 | 0.017432 | -0.04223 | G | Study 1 | CV070 | 237 | 556 |
| 76 | NC0027345 | 4 | 82.5 | 0 | 0.462388 | G | Study 1 | CV070 | 237 | 556 |
| 76 | NC0027345 | 4 | 82.5 | 0.002025 | 0.018139 | G | Study 1 | CV079 | 237 | 556 |
| 76 | NC0104667 | 4 | 82.7 | <.0001 | -0.20518 | GT | Study 3 | -- | 293 | 557 |
| 76 | NC0104667 | 4 | 82.7 | 0.002157 | -0.29628 | GT | Study 1 | CV071 | 293 | 557 |
| 76 | NC0104667 | 4 | 82.7 | 0.04141 | 0.014544 | ** | Study 1 | CV169 | 293 | 557 |
| 76 | NC0104906 | 4 | 82.7 | 0.040377 | -0.11127 | G | Study 1 | CV119 | 124 | 558 |
| 76 | NC0111329 | 4 | 82.7 | 0.001263 | -0.18452 | G | Study 1 | CV131 | 414 | 559 |
| 76 | NC0111329 | 4 | 82.7 | 0.003211 | 0.005229 | C | Study 1 | CV104 | 414 | 559 |
| 76 | NC0111329 | 4 | 82.7 | 0.001082 | 0.23394 | C | Study 1 | CV163 | 414 | 559 |
| 76 | NC0106797 | 4 | 82.9 | -- | -- | T | Study 5 | -- | 87 | 560 |
| 76 | NC0106797 | 4 | 82.9 | 0.029875 | -0.0111 | G | Study 1 | CV010 | 87 | 560 |
| 76 | NC0038999 | 4 | 83.8 | -- | -- | G | Study 5 | -- | 304 | 561 |
| 76 | NC0038999 | 4 | 83.8 | 0.010688 | -0.0201 | G | Study 1 | CV041 | 304 | 561 |
| 76 | NC0038999 | 4 | 83.8 | 0.000002 | 0.03003 | G | Study 1 | CV011 | 304 | 561 |
| 76 | NC0038999 | 4 | 83.8 | 0.042684 | -0.01097 | C | Study 1 | CV086 | 304 | 561 |
| 76 | NC0173808 | 4 | 83.8 | -- | -- | T | Study 5 | -- | 418 | 562 |
| 76 | NC0104785 | 4 | 83.9 | 0 | 0.381728 | A | Study 1 | CV069 | 436 | 563 |

CONT.

| QTL | Marker | Chr | pos | sig | effect | res allele | Mapping Study | Fav. Parent | SNP Position | SEQ ID |
|---|---|---|---|---|---|---|---|---|---|---|
| 76 | NC0104785 | 4 | 83.9 | 0.000189 | 0.183578 | A | Study 1 | CV093 | 436 | 563 |
| 76 | NC0104785 | 4 | 83.9 | 0.002625 | 0.009184 | A | Study 1 | CV101 | 436 | 563 |
| 76 | NC0035294 | 4 | 85.2 | 0.024076 | 0.013558 | G | Study 1 | CV011 | 187 | 564 |
| 76 | NC0039743 | 4 | 87.4 | -- | -- | -- | Study 5 | -- | 149 | 565 |
| 76 | NC0039743 | 4 | 87.4 | 0.007885 | 0.142618 | T | Study 1 | CV164 | 149 | 565 |
| 76 | NC0039743 | 4 | 87.4 | 0.007819 | 0.179661 | T | Study 1 | CV149 | 149 | 565 |
| 76 | NC0111228 | 4 | 87.9 | 0.000847 | -0.01417 | G | Study 1 | CV110 | 130 | 566 |
| 76 | NC0037873 | 4 | 88.3 | 0.004729 | 0.070959 | G | Study 1 | CV135 | 129 | 567 |
| 76 | NC0038782 | 4 | 90.4 | 0.017817 | -0.06569 | A | Study 1 | CV082 | 312 | 568 |
| 77 | NC0022725 | 4 | 91.3 | -- | -- | -- | Study 4 | -- | 145 | 569 |
| 77 | NC0022725 | 4 | 91.3 | 0.014569 | 0.00739 | T | Study 1 | CV101 | 145 | 569 |
| 77 | NC0022725 | 4 | 91.3 | 0 | 0.028689 | T | Study 1 | CV142 | 145 | 569 |
| 77 | NC0022725 | 4 | 91.3 | 0.000175 | 0.019744 | T | Study 1 | CV007 | 145 | 569 |
| 77 | NC0022725 | 4 | 91.3 | 0.003424 | 0.020053 | T | Study 1 | CV014 | 145 | 569 |
| 77 | NC0069570 | 4 | 92.4 | 0.000016 | 0.177653 | C | Study 1 | CV125 | 628 | 570 |
| 77 | NC0069570 | 4 | 92.4 | 0.043046 | 0.128082 | C | Study 1 | CV073 | 628 | 570 |
| 77 | NC0069570 | 4 | 92.4 | 0 | -0.74376 | C | Study 1 | CV130 | 628 | 570 |
| 77 | NC0069570 | 4 | 92.4 | 0.042021 | -0.01291 | C | Study 1 | CV063 | 628 | 570 |
| 77 | NC0002474 | 4 | 93.6 | 0.01513 | -0.14014 | C | Study 1 | CV131 | 383 | 571 |
| 77 | NC0002474 | 4 | 93.6 | 0.000005 | 0.187697 | C | Study 1 | CV166 | 383 | 571 |
| 77 | NC0002474 | 4 | 93.6 | 0.000001 | 0.416992 | C | Study 1 | CV127 | 383 | 571 |
| 77 | NC0002474 | 4 | 93.6 | 0.000937 | 0.03109 | C | Study 1 | CV127 | 383 | 571 |
| 77 | NC0002474 | 4 | 93.6 | 0.011535 | 0.170708 | C | Study 1 | CV149 | 383 | 571 |
| 77 | NC0002474 | 4 | 93.6 | 0.045177 | -0.01169 | C | Study 1 | CV076 | 383 | 571 |
| 77 | NC0002474 | 4 | 93.6 | 0.000001 | 0.041355 | C | Study 1 | CV123 | 383 | 571 |
| 77 | NC0002474 | 4 | 93.6 | 0.010346 | -0.07446 | A | Study 1 | CV119 | 383 | 571 |
| 77 | NC0002474 | 4 | 93.6 | 0.003542 | -0.09518 | A | Study 1 | CV119 | 383 | 571 |
| 77 | NC0005018 | 4 | 94.8 | 0.020494 | 0.004387 | T | Study 1 | CV099 | 646 | 572 |
| 77 | NC0005018 | 4 | 94.8 | 0.000125 | 0.268834 | C | Study 1 | CV163 | 646 | 572 |
| 77 | NC0005018 | 4 | 94.8 | 0.000002 | 0.276417 | C | Study 1 | CV070 | 646 | 572 |
| 77 | NC0005018 | 4 | 94.8 | 0.000695 | 0.020594 | C | Study 1 | CV079 | 646 | 572 |
| 77 | NC0038087 | 4 | 94.8 | 0.047459 | -0.18799 | C | Study 1 | CV071 | 162 | 573 |
| 77 | NC0105550 | 4 | 94.8 | 0.042084 | -0.05111 | CCTACCTTC | Study 1 | CV022 | 241 | 574 |

CONT.

| QTL | Marker | Chr | pos | sig | effect | res allele | Mapping Study | Fav. Parent | SNP Position | SEQ ID |
|---|---|---|---|---|---|---|---|---|---|---|
| 77 | NC0105550 | 4 | 94.8 | 0.001528 | -0.05425 | AGAA CCTACCTTC AGAA | Study 1 | CV010 | 241 | 574 |
| 77 | NC0106845 | 4 | 94.8 | 0 | -0.21668 | G | Study 1 | CV041 | 108 | 575 |
| 77 | NC0106845 | 4 | 94.8 | 0.035358 | 0.11341 | A | Study 1 | CV023 | 108 | 575 |
| 77 | NC0106845 | 4 | 94.8 | 0.027982 | 0.015201 | A | Study 1 | CV144 | 108 | 575 |
| 77 | NC0032557 | 4 | 95.1 | -- | -- | G | Study 5 | -- | 411 | 576 |
| 77 | NC0032557 | 4 | 95.1 | 0.000083 | -0.08371 | C | Study 1 | CV042 | 411 | 576 |
| 77 | NC0040744 | 4 | 95.2 | -- | -- | G | Study 4 | -- | 653 | 577 |
| 77 | NC0105197 | 4 | 99.9 | 0.045255 | -0.03541 | T | Study 1 | CV070 | 321 | 578 |
| 78 | NC0013363 | 4 | 104.1 | 0.005265 | 0.017998 | C | Study 1 | CV011 | 475 | 579 |
| 78 | NC0035313 | 4 | 104.1 | 0.00018 | 0.022705 | T | Study 1 | I283669 | 656 | 580 |
| 78 | NC0003695 | 4 | 104.2 | 0.002552 | 0.019497 | A | Study 1 | CV147 | 329 | 581 |
| 78 | NC0077408 | 4 | 104.3 | -- | -- | C | Study 4 | -- | 294 | 582 |
| 78 | NC0077408 | 4 | 104.3 | 0.009998 | 0.022562 | A | Study 1 | CV158 | 294 | 582 |
| 78 | NC0077408 | 4 | 104.3 | 0.001051 | 0.019541 | A | Study 1 | CV079 | 294 | 582 |
| 78 | NC0077408 | 4 | 104.3 | 0.016847 | -0.01037 | A | Study 1 | CV110 | 294 | 582 |
| 78 | NC0003964 | 4 | 104.4 | 0.001436 | -0.02072 | T | Study 1 | CV025 | 171 | 583 |
| 78 | NC0003964 | 4 | 104.4 | 0 | 0.473329 | G | Study 1 | CV130 | 171 | 583 |
| 78 | NC0003964 | 4 | 104.4 | 0.007501 | 0.158087 | T | Study 1 | CV160 | 171 | 583 |
| 78 | NC0040117 | 4 | 104.4 | 0.003724 | -0.0641 | T | Study 1 | CV042 | 122 | 584 |
| 78 | NC0003274 | 4 | 104.7 | 0.037642 | -0.05837 | G | Study 1 | CV082 | 269 | 585 |
| 78 | NC0003274 | 4 | 104.7 | 0.005747 | -0.04664 | G | Study 1 | CV010 | 269 | 585 |
| 78 | NC0009620 | 4 | 109.2 | 0.020291 | 0.004206 | T | Study 1 | CV104 | 320 | 586 |
| 78 | NC0009620 | 4 | 109.2 | 0.000003 | -0.17596 | G | Study 1 | CV041 | 320 | 586 |
| 78 | NC0009620 | 4 | 109.2 | 0.019022 | 0.126255 | T | Study 1 | CV023 | 320 | 586 |
| 78 | NC0009620 | 4 | 109.2 | 0.011313 | -0.0632 | T | Study 1 | CV022 | 320 | 586 |
| 78 | NC0009620 | 4 | 109.2 | 0.003629 | 0.123458 | T | Study 1 | CV125 | 320 | 586 |
| 78 | NC0009620 | 4 | 109.2 | 0.023061 | 0.291641 | G | Study 1 | CV167 | 320 | 586 |
| 78 | NC0009620 | 4 | 109.2 | 0.017828 | -0.06886 | G | Study 1 | CV119 | 320 | 586 |
| 79 | NC0036240 | 4 | 112 | -- | -- | G | Study 5 | -- | 441 | 587 |
| 79 | NC0036240 | 4 | 112 | 0.01023 | -0.01708 | G | Study 1 | CV025 | 441 | 587 |
| 79 | NC0036240 | 4 | 112 | 0.024741 | 0.019116 | G | Study 1 | CV073 | 441 | 587 |

CONT.

| QTL | Marker | Chr | pos | sig | effect | res allele | Mapping Study | Fav. Parent | SNP Position | SEQ ID |
|---|---|---|---|---|---|---|---|---|---|---|
| 79 | NC0036240 | 4 | 112 | 0.000039 | 0.343262 | G | Study 1 | CV127 | 441 | 587 |
| 79 | NC0036240 | 4 | 112 | 0.017577 | 0.097681 | G | Study 1 | CV114 | 441 | 587 |
| 79 | NC0036240 | 4 | 112 | 0.016853 | 0.131854 | G | Study 1 | CV164 | 441 | 587 |
| 79 | NC0036240 | 4 | 112 | 0.026982 | -0.00988 | A | Study 1 | CV082 | 441 | 587 |
| 79 | NC0036239 | 4 | 112.1 | -- | -- | -- | Study 5 | -- | 341 | 588 |
| 79 | NC0036239 | 4 | 112.1 | 0.042183 | -0.01559 | G | Study 1 | CV139 | 341 | 588 |
| 79 | NC0036239 | 4 | 112.1 | 0.000012 | 0.181805 | G | Study 1 | CV166 | 341 | 588 |
| 79 | NC0036239 | 4 | 112.1 | 0.000008 | -0.54634 | A | Study 1 | CV130 | 341 | 588 |
| 79 | NC0036239 | 4 | 112.1 | 0.003658 | 0.171721 | G | Study 1 | CV160 | 341 | 588 |
| 79 | NC0036239 | 4 | 112.1 | 0.009936 | 0.016277 | G | Study 1 | CV147 | 341 | 588 |
| 79 | NC0036239 | 4 | 112.1 | 0.025516 | -0.00945 | A | Study 1 | CV110 | 341 | 588 |
| 79 | NC0110078 | 4 | 115.7 | 0.000071 | -0.31393 | G | Study 1 | CV069 | 99 | 589 |
| 79 | NC0110078 | 4 | 115.7 | 0.000002 | 0.241478 | G | Study 1 | CV069 | 99 | 589 |
| 79 | NC0110078 | 4 | 115.7 | 0.03438 | 0.059353 | G | Study 1 | CV050 | 99 | 589 |
| 79 | NC0110078 | 4 | 115.7 | 0.033718 | 0.006928 | G | Study 1 | CV050 | 99 | 589 |
| 79 | NC0110078 | 4 | 115.7 | 0.000695 | 0.242005 | G | Study 1 | CV163 | 99 | 589 |
| 79 | NC0110078 | 4 | 115.7 | 0.007778 | 0.016302 | C | Study 1 | CV147 | 99 | 589 |
| 79 | NC0110078 | 4 | 115.7 | 0.000005 | 0.032636 | C | Study 1 | CV014 | 99 | 589 |
| 79 | NC0108028 | 4 | 116.8 | 0.04105 | -0.01591 | C | Study 1 | CV017 | 278 | 590 |
| 79 | NC0108028 | 4 | 116.8 | 0.002916 | 0.382678 | C | Study 1 | CV167 | 278 | 590 |
| 79 | NC0108028 | 4 | 116.8 | 0.039163 | -0.18921 | T | Study 1 | CV071 | 278 | 590 |
| 79 | NC0108028 | 4 | 116.8 | 0.020054 | 0.022985 | T | Study 1 | CV165 | 278 | 590 |
| 79 | NC0200096 | 4 | 120.8 | -- | -- | T | Study 5 | -- | 165 | 591 |
| 80 | NC0156254 | 4 | 121 | 0.035897 | 0.007724 | A | Study 1 | CV151 | 149 | 592 |
| 80 | NC0156254 | 4 | 121 | 0.000817 | 0.136901 | A | Study 1 | CV166 | 149 | 592 |
| 80 | NC0156254 | 4 | 121 | 0.001206 | 0.190333 | A | Study 1 | CV070 | 149 | 592 |
| 80 | NC0156254 | 4 | 121 | 0.008213 | 0.015944 | A | Study 1 | CV079 | 149 | 592 |
| 80 | NC0156254 | 4 | 121 | 0 | 0.03057 | A | Study 1 | CV142 | 149 | 592 |
| 80 | NC0156254 | 4 | 121 | 0.015808 | 0.013488 | A | Study 1 | CV007 | 149 | 592 |
| 80 | NC0156254 | 4 | 121 | 0.035707 | 0.009546 | A | Study 1 | CV012 | 149 | 592 |
| 80 | NC0156254 | 4 | 121 | 0.035707 | 0.009546 | A | Study 1 | CV012 | 149 | 592 |
| 80 | NC0156263 | 4 | 121 | -- | -- | T | Study 4 | -- | 338 | 593 |
| 80 | NC0156267 | 4 | 121 | -- | -- | T | Study 4 | -- | 321 | 594 |

CONT.

| QTL | Marker | Chr | pos | sig | effect | res allele | Mapping Study | Fav. Parent | SNP Position | SEQ ID |
|---|---|---|---|---|---|---|---|---|---|---|
| 80 | NC0039511 | 4 | 121.5 | -- | -- | G | Study 5 | -- | 560 | 595 |
| 80 | NC0039511 | 4 | 121.5 | 0.022372 | 0.009608 | G | Study 1 | CV170 | 560 | 595 |
| 80 | NC0039511 | 4 | 121.5 | 0.042406 | 0.01691 | G | Study 1 | CV123 | 560 | 595 |
| 80 | NC0188975 | 4 | 126.7 | -- | -- | G | Study 5 | -- | 635 | 596 |
| 80 | NC0151518 | 4 | 127 | 0.006623 | -0.35117 | A | Study 1 | CV130 | 104 | 597 |
| 80 | NC0188276 | 4 | 127.5 | -- | -- | T | Study 5 | -- | 350 | 598 |
| 80 | NC0028933 | 4 | 127.6 | -- | -- | C | Study 4 | -- | 355 | 599 |
| 80 | NC0028933 | 4 | 127.6 | 0.04462 | 0.008424 | C | Study 1 | CV170 | 355 | 599 |
| 80 | NC0029886 | 4 | 127.8 | 0.043421 | -0.00968 | C | Study 1 | CV053 | 396 | 600 |
| 80 | NC0008979 | 4 | 127.9 | 0.008463 | -0.04644 | A | Study 1 | CV010 | 194 | 601 |
| 80 | NC0008979 | 4 | 127.9 | 0.017245 | 0.203714 | A | Study 1 | CV130 | 194 | 601 |
| 80 | NC0050947 | 4 | 127.9 | 0.047997 | 0.100547 | ***** | Study 1 | CV023 | 236 | 602 |
| 80 | NC0050968 | 4 | 127.9 | -- | -- | T | Study 5 | -- | 107 | 603 |
| 81 | NC0070533 | 4 | 130.2 | 0.02702 | 0.003876 | C | Study 1 | CV104 | 439 | 604 |
| 81 | NC0070533 | 4 | 130.2 | 0.007117 | 0.014204 | C | Study 1 | I283669 | 439 | 604 |
| 81 | NC0070533 | 4 | 130.2 | 0.002614 | 0.176235 | T | Study 1 | CV070 | 439 | 604 |
| 81 | NC0070533 | 4 | 130.2 | 0 | 0.031388 | T | Study 1 | CV142 | 439 | 604 |
| 81 | NC0054460 | 4 | 131.7 | -- | -- | T | Study 4 | -- | 411 | 605 |
| 81 | NC0054460 | 4 | 131.7 | 0.000002 | 0.251888 | A | Study 1 | CV069 | 411 | 605 |
| 81 | NC0054460 | 4 | 131.7 | 0.000015 | 0.190583 | A | Study 1 | CV093 | 411 | 605 |
| 81 | NC0054460 | 4 | 131.7 | 0.039979 | 0.084234 | T | Study 1 | CV114 | 411 | 605 |
| 81 | NC0054460 | 4 | 131.7 | 0.045292 | 0.007578 | A | Study 1 | CV151 | 411 | 605 |
| 81 | NC0054460 | 4 | 131.7 | 0.000058 | 0.109146 | A | Study 1 | CV050 | 411 | 605 |
| 81 | NC0054460 | 4 | 131.7 | 0.001028 | 0.010642 | A | Study 1 | CV050 | 411 | 605 |
| 81 | NC0054460 | 4 | 131.7 | 0.024882 | 0.012421 | A | Study 1 | CV007 | 411 | 605 |
| 81 | NC0054460 | 4 | 131.7 | 0 | 0.034177 | A | Study 1 | CV014 | 411 | 605 |
| 81 | NC0106263 | 4 | 133 | -- | -- | G | Study 5 | -- | 204 | 606 |
| 81 | NC0035451 | 4 | 133.5 | -- | -- | G | Study 5 | -- | 650 | 607 |
| 81 | NC0036646 | 4 | 134.7 | 0.007646 | -0.00385 | A | Study 1 | CV100 | 54 | 608 |
| 81 | NC0036646 | 4 | 134.7 | 0.007646 | -0.00385 | A | Study 1 | CV100 | 54 | 608 |
| 81 | NC0048771 | 4 | 134.7 | 0.0004 | 0.127462 | C | Study 3 | -- | 56 | 609 |
| 81 | NC0005295 | 4 | 135.1 | -- | -- | T | Study 4 | -- | 266 | 610 |
| 81 | NC0005295 | 4 | 135.1 | 0.002733 | 0.01227 | C | Study 1 | 12053 | 266 | 610 |

CONT.

| QTL | Marker | Chr | pos | sig | effect | res allele | Mapping Study | Fav. Parent | SNP Position | SEQ ID |
|---|---|---|---|---|---|---|---|---|---|---|
| 81 | NC0005295 | 4 | 135.1 | 0.006428 | 0.348799 | T | Study 1 | CV167 | 266 | 610 |
| 81 | NC0005295 | 4 | 135.1 | 0.012517 | 0.214997 | C | Study 1 | CV127 | 266 | 610 |
| 81 | NC0005295 | 4 | 135.1 | 0.033969 | 0.020854 | C | Study 1 | CV165 | 266 | 610 |
| 81 | NC0071158 | 4 | 136.7 | 0.002645 | 0.125837 | G | Study 1 | CV166 | 775 | 611 |
| 81 | NC0071158 | 4 | 136.7 | 0.01618 | 0.132035 | G | Study 1 | CV164 | 775 | 611 |
| 81 | NC0071158 | 4 | 136.7 | 0.020795 | 0.010505 | G | Study 1 | CV012 | 775 | 611 |
| 81 | NC0071158 | 4 | 136.7 | 0.020795 | 0.010505 | G | Study 1 | CV012 | 775 | 611 |
| 81 | NC0040357 | 4 | 137.5 | -- | -- | G | Study 4 | -- | 202 | 612 |
| 81 | NC0040357 | 4 | 137.5 | 0.013634 | 0.07406 | A | Study 1 | CV148 | 202 | 612 |
| 81 | NC0067159 | 4 | 137.6 | -- | -- | G | Study 4 | -- | 561 | 613 |
| 81 | NC0031964 | 4 | 138 | <.0001 | 0.321427 | T | Study 3 | -- | 699 | 614 |
| 81 | NC0031964 | 4 | 138 | -- | -- | T | Study 4 | -- | 699 | 614 |
| 81 | NC0071447 | 4 | 138.3 | <.0001 | -0.27384 | CG | Study 3 | -- | 163 | 615 |
| 81 | NC0071447 | 4 | 138.3 | -- | -- | ** | Study 4 | -- | 163 | 615 |
| 81 | NC0171661 | 4 | 138.7 | -- | -- | G | Study 5 | -- | 43 | 616 |
| 81 | NC0004170 | 4 | 139.4 | -- | -- | G | Study 4 | -- | 116 | 617 |
| 81 | NC0004170 | 4 | 139.4 | 0.000186 | -0.01048 | A | Study 1 | CV138 | 116 | 617 |
| 81 | NC0004170 | 4 | 139.4 | 0.004353 | 0.015603 | G | Study 1 | CV007 | 116 | 617 |
| 81 | NC0038447 | 4 | 141.8 | 0.001423 | 0.034247 | G | Study 4 | -- | 526 | 618 |
| 81 | NC0104975 | 4 | 142 | 0.000233 | 0.041955 | G | Study 4 | -- | 306 | 619 |
| 82 | NC0110764 | 4 | 142 | 0.001688 | 0.187588 | T | Study 1 | CV070 | 144 | 620 |
| 82 | NC0009491 | 4 | 144.6 | 0.000359 | -0.25536 | G | Study 1 | CV069 | 236 | 621 |
| 82 | NC0009491 | 4 | 144.6 | 0 | 0.031203 | G | Study 1 | CV142 | 236 | 621 |
| 82 | NC0104484 | 4 | 147.3 | 0.006728 | 0.023916 | T | Study 1 | CV158 | 59 | 622 |
| 82 | NC0020933 | 4 | 147.5 | <.0001 | 0.147783 | T | Study 1 | -- | 373 | 623 |
| 82 | NC0020933 | 4 | 147.5 | -- | -- | T | Study 3 | -- | 373 | 623 |
| 82 | NC0020934 | 4 | 147.5 | -- | -- | G | Study 4 | -- | 173 | 624 |
| 82 | NC0111505 | 4 | 148.2 | 0.036763 | 0.128302 | G | Study 5 | -- | 217 | 625 |
| 82 | NC0111505 | 4 | 148.2 | 0.028097 | 0.12962 | A | Study 1 | CV159 | 217 | 625 |
| 83 | NC0035950 | 4 | 153.3 | 0.000398 | 0.17912 | C | Study 1 | CV070 | 571 | 626 |
| 83 | NC0030576 | 4 | 153.8 | 0.049854 | 0.069956 | C | Study 1 | CV069 | 873 | 627 |
| 83 | NC0030576 | 4 | 153.8 | 0.000002 | 0.026757 | C | Study 1 | CV126 | 873 | 627 |
| 83 | NC0030576 | 4 | 153.8 | | | | Study 1 | CV142 | 873 | 627 |

CONT.

| QTL | Marker | Chr | pos | sig | effect | res allele | Mapping Study | Fav. Parent | SNP Position | SEQ ID |
|---|---|---|---|---|---|---|---|---|---|---|
| 83 | NC0107293 | 4 | 155.5 | -- | -- | C | Study 5 | -- | 381 | 628 |
| 83 | NC0028579 | 4 | 155.7 | -- | -- | C | Study 4 | -- | 242 | 629 |
| 83 | NC0028579 | 4 | 155.7 | 0.018466 | 0.009028 | C | Study 1 | CV151 | 242 | 629 |
| 83 | NC0028579 | 4 | 155.7 | 0.048592 | 0.011181 | C | Study 1 | CV011 | 242 | 629 |
| 83 | NC0034250 | 4 | 156.3 | <.0001 | 0.192093 | T | Study 3 | -- | 70 | 630 |
| 83 | NC0034250 | 4 | 156.3 | 0.049099 | 0.109113 | G | Study 1 | CV023 | 70 | 630 |
| 83 | NC0034250 | 4 | 156.3 | 0.00995 | -0.00375 | G | Study 1 | CV100 | 70 | 630 |
| 83 | NC0034250 | 4 | 156.3 | 0.00995 | -0.00375 | G | Study 1 | CV100 | 70 | 630 |
| 83 | NC0031931 | 4 | 156.4 | -- | -- | G | Study 4 | -- | 209 | 631 |
| 83 | NC0031931 | 4 | 156.4 | 0.013771 | -0.06788 | G | Study 1 | CV011 | 209 | 631 |
| 83 | NC0031931 | 4 | 156.4 | 0.000014 | 0.027361 | A | Study 1 | CV014 | 209 | 631 |
| 83 | NC0051079 | 4 | 156.4 | -- | -- | G | Study 4 | -- | 137 | 632 |
| 83 | NC0051079 | 4 | 156.4 | 0.000001 | 0.139448 | G | Study 1 | CV050 | 137 | 632 |
| 83 | NC0051079 | 4 | 156.4 | 0.005217 | 0.009441 | G | Study 1 | CV050 | 137 | 632 |
| 84 | NC0199540 | 4 | 160.6 | -- | -- | T | Study 5 | -- | 100 | 633 |
| 84 | NC0037175 | 4 | 161.2 | -- | -- | C | Study 4 | -- | 473 | 634 |
| 84 | NC0008860 | 4 | 162 | -- | -- | G | Study 4 | -- | 327 | 635 |
| 84 | NC0008860 | 4 | 162 | 0.0237 | -0.00616 | G | Study 1 | I294213 | 327 | 635 |
| 84 | NC0008860 | 4 | 162 | 0.025643 | -0.0108 | G | Study 1 | CV087 | 327 | 635 |
| 84 | NC0008860 | 4 | 162 | 0.000009 | 0.205429 | A | Study 1 | CV093 | 327 | 635 |
| 84 | NC0008860 | 4 | 162 | 0.03238 | -0.07148 | A | Study 1 | CV101 | 327 | 635 |
| 84 | NC0008860 | 4 | 162 | 0.035811 | 0.074083 | A | Study 1 | CV162 | 327 | 635 |
| 84 | NC0008860 | 4 | 162 | 0.000007 | 0.024882 | A | Study 1 | CV142 | 327 | 635 |
| 84 | NC0002755 | 4 | 162.2 | 0.045316 | -0.01087 | C | Study 1 | CV136 | 121 | 636 |
| 84 | NC0037601 | 4 | 162.2 | 0.000674 | 0.118255 | A | Study 1 | CV126 | 478 | 637 |
| 84 | NC0032049 | 4 | 162.6 | 0.041639 | -0.08006 | C | Study 1 | CV075 | 154 | 638 |
| 84 | NC0110455 | 4 | 169.4 | 0.040036 | 0.023981 | C | Study 1 | CV155 | 207 | 639 |
| 85 | NC0009398 | 4 | 173.5 | 0.024524 | -0.01469 | C | Study 1 | CV025 | 191 | 640 |
| 85 | NC0199468 | 4 | 173.5 | -- | -- | G | Study 5 | -- | 231 | 641 |
| 85 | NC0003224 | 4 | 173.6 | 0.000604 | 0.098138 | C | Study 1 | CV050 | 169 | 642 |
| 85 | NC0003226 | 4 | 173.6 | 0.016723 | 0.004286 | T | Study 1 | CV104 | 399 | 643 |
| 85 | NC0003226 | 4 | 173.6 | 0.042055 | -0.0153 | T | Study 1 | CV112 | 399 | 643 |
| 85 | NC0003226 | 4 | 173.6 | 0.010836 | 0.028464 | T | Study 1 | CV154 | 399 | 643 |

CONT.

| QTL | Marker | Chr | pos | sig | effect | res allele | Mapping Study | Fav. Parent | SNP Position | SEQ ID |
|---|---|---|---|---|---|---|---|---|---|---|
| 85 | NC0004445 | 4 | 176.6 | -- | -- | T | Study 4 | -- | 274 | 644 |
| 85 | NC0004445 | 4 | 176.6 | 0.046938 | -0.04505 | T | Study 1 | CV022 | 274 | 644 |
| 85 | NC0004445 | 4 | 176.6 | 0.021117 | 0.01441 | C | Study 1 | CV159 | 274 | 644 |
| 85 | NC0004445 | 4 | 176.6 | 0.000347 | 0.023073 | T | Study 1 | CV014 | 274 | 644 |
| 85 | NC0036635 | 4 | 179.7 | 0.01015 | -0.07932 | T | Study 1 | CV064 | 596 | 645 |
| 86 | NC0009066 | 4 | 181 | 0.049211 | 0.005578 | T | Study 1 | CV082 | 238 | 646 |
| 86 | NC0030985 | 4 | 181.9 | -- | -- | ********** | Study 4 | -- | 164 | 647 |
| 86 | NC0030985 | 4 | 181.9 | 0.033538 | 0.009354 | ACTGTTCCAAG | Study 1 | CV142 | 164 | 647 |
| 86 | NC0030985 | 4 | 181.9 | 0.038253 | 0.071991 | ACTGTTCCAAG | Study 1 | CV162 | 164 | 647 |
| 86 | NC0030985 | 4 | 181.9 | 0.00436 | 0.100548 | ACTGTTCCAAG | Study 1 | CV126 | 164 | 647 |
| 86 | NC0030985 | 4 | 181.9 | 0.009623 | 0.014733 | ACTGTTCCAAG | Study 1 | CV142 | 164 | 647 |
| 86 | NC0030985 | 4 | 181.9 | 0.033457 | -0.00632 | ********** | Study 1 | CV138 | 164 | 647 |
| 86 | NC0145280 | 4 | 183 | <.0001 | 0.124927 | C | Study 3 | -- | 748 | 648 |
| 86 | NC0145280 | 4 | 183 | 0.011246 | -0.11937 | C | Study 1 | CV068 | 748 | 648 |
| 86 | NC0145280 | 4 | 183 | 0.004805 | -0.07397 | C | Study 1 | CV011 | 748 | 648 |
| 86 | NC0145280 | 4 | 183 | 0.032174 | -0.13274 | C | Study 1 | CV017 | 748 | 648 |
| 86 | NC0148181 | 4 | 183 | 0.002 | -0.10807 | G | Study 3 | -- | 1001 | 649 |
| 86 | NC0148181 | 4 | 183 | -- | -- | G | Study 4 | -- | 1001 | 649 |
| 86 | NC0043794 | 4 | 186.2 | -- | -- | T | Study 5 | -- | 197 | 650 |
| 86 | NC0112943 | 4 | 186.4 | 0.024778 | -0.05893 | C | Study 1 | CV011 | 134 | 651 |
| 86 | NC0112943 | 4 | 186.4 | 0.042048 | -0.04288 | C | Study 1 | CV022 | 134 | 651 |
| 86 | NC0112943 | 4 | 186.4 | 0.042324 | -0.12706 | T | Study 1 | CV017 | 134 | 651 |
| 86 | NC0112943 | 4 | 186.4 | 0.043392 | 0.072424 | C | Study 1 | CV162 | 134 | 651 |
| 86 | NC0112943 | 4 | 186.4 | 0.028007 | 0.012576 | C | Study 1 | CV142 | 134 | 651 |
| 86 | NC0030211 | 4 | 186.7 | 0.000635 | -0.01406 | T | Study 1 | CV099 | 185 | 652 |
| 86 | NC0030211 | 4 | 186.7 | 0.027387 | -0.06839 | T | Study 1 | CV064 | 185 | 652 |
| 86 | NC0030211 | 4 | 186.7 | 0.007057 | 0.029412 | T | Study 1 | CV154 | 185 | 652 |
| 86 | NC0030211 | 4 | 186.7 | 0.033082 | -0.01412 | C | Study 1 | CV025 | 185 | 652 |
| 86 | NC0043121 | 4 | 186.7 | <.0001 | 0.281569 | G | Study 3 | -- | 299 | 653 |
| 87 | NC0040159 | 4 | 190 | -- | -- | **** | Study 4 | -- | 200 | 654 |

CONT.

| QTL | Marker | Chr | pos | sig | effect | res allele | Mapping Study | Fav. Parent | SNP Position | SEQ ID |
|---|---|---|---|---|---|---|---|---|---|---|
| 87 | NC0040159 | 4 | 190 | 0.009711 | 0.00432 | TATA | Study 1 | CV104 | 200 | 654 |
| 87 | NC0040159 | 4 | 190 | 0.01592 | -0.00554 | **** | Study 1 | CV043 | 200 | 654 |
| 87 | NC0040159 | 4 | 190 | 0.011361 | 0.009413 | TATA | Study 1 | CV151 | 200 | 654 |
| 87 | NC0035338 | 4 | 190.6 | -- | -- | -- | Study 4 | -- | 105 | 655 |
| 87 | NC0035338 | 4 | 190.6 | 0.038089 | 0.006182 | G | Study 1 | CV082 | 105 | 655 |
| 87 | NC0010790 | 4 | 190.8 | -- | -- | C | Study 5 | -- | 74 | 656 |
| 88 | NC0024265 | 5 | 1.8 | 0.01723 | -0.00622 | G | Study 1 | CV056 | 137 | 657 |
| 88 | NC0024265 | 5 | 1.8 | 0.036274 | 0.070527 | A | Study 1 | CV082 | 137 | 657 |
| 88 | NC0024265 | 5 | 1.8 | 0.028172 | -0.0101 | G | Study 1 | CV098 | 137 | 657 |
| 88 | NC0024265 | 5 | 1.8 | 0.022559 | -0.01376 | G | Study 1 | CV044 | 137 | 657 |
| 88 | NC0024265 | 5 | 1.8 | 0.008646 | 0.206122 | G | Study 1 | CV073 | 137 | 657 |
| 88 | NC0024265 | 5 | 1.8 | 0.001291 | 0.09148 | G | Study 1 | CV050 | 137 | 657 |
| 88 | NC0024265 | 5 | 1.8 | 0.037561 | 0.006886 | G | Study 1 | CV050 | 137 | 657 |
| 88 | NC0024265 | 5 | 1.8 | 0.030883 | 0.006409 | G | Study 1 | CV091 | 137 | 657 |
| 88 | NC0031790 | 5 | 1.8 | 0.044924 | 0.110102 | A | Study 1 | CV164 | 551 | 658 |
| 88 | NC0031790 | 5 | 1.8 | 0.020904 | 0.008364 | A | Study 1 | CV164 | 551 | 658 |
| 88 | NC0143354 | 5 | 1.8 | -- | -- | G | Study 4 | -- | 303 | 659 |
| 88 | NC0143354 | 5 | 1.8 | 0.044211 | -0.01489 | G | Study 1 | CV021 | 303 | 659 |
| 88 | NC0143354 | 5 | 1.8 | 0.009699 | -0.08668 | C | Study 1 | CV101 | 303 | 659 |
| 88 | NC0143354 | 5 | 1.8 | 0.011408 | 0.011148 | C | Study 1 | CV137 | 303 | 659 |
| 88 | NC0023752 | 5 | 2.3 | 0.049939 | 0.008109 | C | Study 1 | CV100 | 65 | 660 |
| 89 | NC0197086 | 5 | 11.6 | -- | -- | G | Study 5 | -- | 455 | 661 |
| 89 | NC0014633 | 5 | 11.7 | 0.024737 | -0.08023 | G | Study 1 | CV041 | 147 | 662 |
| 89 | NC0014633 | 5 | 11.7 | 0.004154 | 0.050754 | A | Study 1 | CV100 | 147 | 662 |
| 89 | NC0014633 | 5 | 11.7 | 0.030832 | -0.01061 | G | Study 1 | CV087 | 147 | 662 |
| 89 | NC0004808 | 5 | 12.3 | 0.019259 | 0.20192 | C | Study 1 | CV127 | 363 | 663 |
| 89 | NC0036565 | 5 | 14.7 | 0.011172 | 0.078967 | A | Study 1 | CV131 | 211 | 664 |
| 89 | NC0036565 | 5 | 14.7 | 0.005855 | -0.21688 | T | Study 1 | I294213 | 211 | 664 |
| 89 | NC0036565 | 5 | 14.7 | 0.006111 | -0.03261 | T | Study 1 | I294213 | 211 | 664 |
| 89 | NC0036565 | 5 | 14.7 | 0.003651 | 0.083309 | A | Study 1 | CV050 | 211 | 664 |
| 89 | NC0036565 | 5 | 14.7 | 0.019528 | 0.007883 | A | Study 1 | CV050 | 211 | 664 |
| 89 | NC0036565 | 5 | 14.7 | 0.04251 | -0.17268 | A | Study 1 | CV047 | 211 | 664 |
| 89 | NC0036565 | 5 | 14.7 | 0.027052 | 0.02151 | A | Study 1 | CV165 | 211 | 664 |

CONT.

| QTL | Marker | Chr | pos | sig | effect | res allele | Mapping Study | Fav. Parent | SNP Position | SEQ ID |
|---|---|---|---|---|---|---|---|---|---|---|
| 89 | NC0069592 | 5 | 14.8 | -- | -- | ** | Study 4 | -- | 439 | 665 |
| 89 | NC0069592 | 5 | 14.8 | 0.021357 | 0.184966 | AT | Study 1 | CV073 | 439 | 665 |
| 89 | NC0104988 | 5 | 15.9 | 0.040479 | 0.036266 | TTGTA | Study 1 | CV119 | 448 | 666 |
| 89 | NC0105613 | 5 | 16.6 | -- | -- | -- | Study 4 | -- | 178 | 667 |
| 89 | NC0105613 | 5 | 16.6 | 0.020544 | 0.01634 | G | Study 1 | CV080 | 178 | 667 |
| 89 | NC0105613 | 5 | 16.6 | 0.013826 | -0.09745 | C | Study 1 | CV041 | 178 | 667 |
| 89 | NC0105613 | 5 | 16.6 | 0.001024 | 0.019979 | G | Study 1 | I283669 | 178 | 667 |
| 89 | NC0105613 | 5 | 16.6 | 0.047034 | -0.01199 | G | Study 1 | CV044 | 178 | 667 |
| 89 | NC0105613 | 5 | 16.6 | 0.033411 | 0.184423 | G | Study 1 | CV127 | 178 | 667 |
| 89 | NC0105613 | 5 | 16.6 | 0.027558 | 0.023812 | C | Study 1 | CV154 | 178 | 667 |
| 89 | NC0105613 | 5 | 16.6 | 0.025033 | -0.01324 | C | Study 1 | CV100 | 178 | 667 |
| 89 | NC0107858 | 5 | 17.1 | <.0001 | -0.18596 | C | Study 3 | -- | 401 | 668 |
| 89 | NC0107858 | 5 | 17.1 | 0.024955 | 0.009371 | T | Study 1 | CV012 | 401 | 668 |
| 89 | NC0107858 | 5 | 17.1 | 0.038418 | -0.0128 | C | Study 1 | CV077 | 401 | 668 |
| 89 | NC0107858 | 5 | 17.1 | 0.005486 | 0.012583 | T | Study 1 | CV012 | 401 | 668 |
| 89 | NC0107858 | 5 | 17.1 | 0.005486 | 0.012583 | T | Study 1 | CV012 | 401 | 668 |
| 90 | NC0011193 | 5 | 29.3 | 0.002149 | 0.090782 | T | Study 1 | CV131 | 82 | 669 |
| 90 | NC0011193 | 5 | 29.3 | 0.045161 | 0.008304 | T | Study 1 | CV012 | 82 | 669 |
| 90 | NC0011193 | 5 | 29.3 | 0.040335 | 0.00742 | A | Study 1 | CV164 | 82 | 669 |
| 90 | NC0108373 | 5 | 29.5 | 0.012477 | 0.042615 | T | Study 1 | CV100 | 240 | 670 |
| 90 | NC0108373 | 5 | 29.5 | 0.025189 | 0.009511 | T | Study 1 | CV100 | 240 | 670 |
| 90 | NC0108373 | 5 | 29.5 | 0.007469 | -0.01591 | T | Study 1 | CV100 | 240 | 670 |
| 91 | NC0000091 | 5 | 30.2 | <.0001 | 0.147445 | T | Study 3 | -- | 111 | 671 |
| 91 | NC0000091 | 5 | 30.2 | 0.018784 | 0.027153 | C | Study 1 | CV165 | 111 | 671 |
| 91 | NC0000091 | 5 | 30.2 | 0.006631 | 0.027022 | C | Study 1 | CV165 | 111 | 671 |
| 91 | NC0055976 | 5 | 32.1 | 0.004596 | 0.081391 | C | Study 1 | CV050 | 332 | 672 |
| 91 | NC0005275 | 5 | 36 | 0.015112 | -0.00907 | A | Study 1 | CV040 | 223 | 673 |
| 91 | NC0020668 | 5 | 36.2 | 0.043797 | -0.10829 | T | Study 1 | CV071 | 542 | 674 |
| 92 | NC0038726 | 5 | 40.1 | 0.000277 | 0.110285 | T | Study 2 | -- | 652 | 675 |
| 92 | NC0038726 | 5 | 40.1 | -- | -- | T | Study 4 | -- | 652 | 675 |
| 92 | NC0079943 | 5 | 40.2 | 0.001224 | 0.099001 | G | Study 1 | CV131 | 301 | 676 |
| 92 | NC0079943 | 5 | 40.2 | 0.001918 | -0.01933 | G | Study 1 | CV100 | 301 | 676 |
| 92 | NC0079943 | 5 | 40.2 | 0.006936 | 0.020001 | G | Study 1 | CV165 | 301 | 676 |

CONT.

| QTL | Marker | Chr | pos | sig | effect | res allele | Mapping Study | Fav. Parent | SNP Position | SEQ ID |
|---|---|---|---|---|---|---|---|---|---|---|
| 92 | NC0012935 | 5 | 45.7 | 0.042187 | 0.178786 | G | Study 1 | CV109 | 437 | 677 |
| 92 | NC0012935 | 5 | 45.7 | 0.00522 | -0.12506 | G | Study 1 | 1294213 | 437 | 677 |
| 92 | NC0012935 | 5 | 45.7 | 0.037904 | -0.05606 | A | Study 1 | CV050 | 437 | 677 |
| 92 | NC0012935 | 5 | 45.7 | 0.028096 | -0.01035 | A | Study 1 | CV088 | 437 | 677 |
| 92 | NC0109403 | 5 | 46.7 | 0.010929 | -0.14865 | TTC | Study 1 | CV131 | 523 | 678 |
| 92 | NC0109403 | 5 | 46.7 | 0.000109 | 0.135392 | *** | Study 1 | CV082 | 523 | 678 |
| 92 | NC0109403 | 5 | 46.7 | 0.047712 | -0.10764 | *** | Study 1 | CV071 | 523 | 678 |
| 93 | NC0037588 | 5 | 60.1 | 0.039041 | -0.12071 | CACAA | Study 1 | CV131 | 188 | 679 |
| 93 | NC0016762 | 5 | 60.6 | 0.0055 | -0.10018 | A | Study 3 | --- | 380 | 680 |
| 93 | NC0016762 | 5 | 60.6 | 0.039943 | -0.25599 | C | Study 1 | CV112 | 380 | 680 |
| 93 | NC0109342 | 5 | 61.7 | 0.027159 | 0.053014 | A | Study 1 | CV082 | 526 | 681 |
| 93 | NC0109342 | 5 | 61.7 | 0.034023 | 0.017582 | A | Study 1 | CV165 | 526 | 681 |
| 93 | NC0054720 | 5 | 62 | --- | --- | T | Study 5 | --- | 272 | 682 |
| 93 | NC0054720 | 5 | 62 | 0.003461 | 0.270999 | T | Study 1 | CV130 | 272 | 682 |
| 93 | NC0079573 | 5 | 62 | 0.002 | -0.09406 | C | Study 3 | --- | 222 | 683 |
| 93 | NC0031205 | 5 | 62.9 | 3.58E-10 | 0.177709 | T | Study 2 | --- | 618 | 684 |
| 93 | NC0031205 | 5 | 62.9 | 0.000312 | 0.015291 | T | Study 1 | CV012 | 618 | 684 |
| 93 | NC0079519 | 5 | 63.1 | 0.012725 | 0.0123 | C | Study 1 | CV069 | 436 | 685 |
| 93 | NC0018546 | 5 | 63.5 | 0.003896 | 0.169357 | A | Study 1 | CV023 | 66 | 686 |
| 93 | NC0018546 | 5 | 63.5 | 0.049702 | 0.009776 | A | Study 1 | CV082 | 66 | 686 |
| 93 | NC0018546 | 5 | 63.5 | 0.001414 | -0.09224 | A | Study 1 | CV082 | 66 | 686 |
| 93 | NC0018546 | 5 | 63.5 | 0.000151 | 0.14127 | A | Study 1 | CV082 | 66 | 686 |
| 93 | NC0018546 | 5 | 63.5 | 0.048784 | 0.034193 | G | Study 1 | CV100 | 66 | 686 |
| 93 | NC0018546 | 5 | 63.5 | 0.009855 | 0.017946 | A | Study 1 | CV112 | 66 | 686 |
| 93 | NC0018546 | 5 | 63.5 | 0.021869 | 0.144981 | A | Study 1 | CV073 | 66 | 686 |
| 93 | NC0018546 | 5 | 63.5 | 0.008933 | -0.01584 | A | Study 1 | CV100 | 66 | 686 |
| 93 | NC0018546 | 5 | 63.5 | 0.018979 | 0.013575 | G | Study 1 | CV159 | 66 | 686 |
| 93 | NC0018546 | 5 | 63.5 | 0.032536 | -0.01022 | G | Study 1 | CV110 | 66 | 686 |
| 93 | NC0018546 | 5 | 63.5 | 0.036959 | -0.01064 | A | Study 1 | CV082 | 66 | 686 |
| 93 | NC0199433 | 5 | 63.5 | --- | --- | G | Study 5 | --- | 724 | 687 |
| 93 | NC0009668 | 5 | 65.2 | <.0001 | 0.166527 | G | Study 3 | --- | 107 | 688 |
| 93 | NC0111388 | 5 | 66.6 | 0.020975 | 0.07622 | C | Study 1 | CV131 | 64 | 689 |
| 93 | NC0111398 | 5 | 67.7 | 0.006721 | 0.01177 | T | Study 1 | CV012 | 171 | 690 |

CONT.

| QTL | Marker | Chr | pos | sig | effect | res allele | Mapping Study | Fav. Parent | SNP Position | SEQ ID |
|---|---|---|---|---|---|---|---|---|---|---|
| 93 | NC0113139 | 5 | 68.6 | 0.0002 | -0.18881 | C | Study 3 | -- | 269 | 691 |
| 93 | NC0113139 | 5 | 68.6 | 0.002636 | -0.08048 | G | Study 1 | CV050 | 269 | 691 |
| 93 | NC0113139 | 5 | 68.6 | 0.029127 | -0.01273 | G | Study 1 | CV040 | 269 | 691 |
| 93 | NC0113139 | 5 | 68.6 | 0.007352 | -0.21602 | G | Study 1 | CV044 | 269 | 691 |
| 93 | NC0052081 | 5 | 69.4 | -- | -- | T | Study 5 | -- | 351 | 692 |
| 93 | NC0052081 | 5 | 69.4 | 0.034698 | 0.011166 | C | Study 1 | CV006 | 351 | 692 |
| 94 | NC0146546 | 5 | 71.2 | -- | -- | T | Study 5 | -- | 359 | 693 |
| 94 | NC0008797 | 5 | 72 | 0.028122 | 0.018832 | A | Study 1 | CV161 | 247 | 694 |
| 94 | NC0158175 | 5 | 72 | -- | -- | T | Study 5 | -- | 388 | 695 |
| 94 | NC0172718 | 5 | 72 | -- | -- | G | Study 5 | -- | 121 | 696 |
| 94 | NC0057859 | 5 | 72.4 | <.0001 | 0.241238 | T | Study 3 | -- | 424 | 697 |
| 94 | NC0057859 | 5 | 72.4 | 0.001707 | 0.282958 | C | Study 1 | CV130 | 424 | 697 |
| 94 | NC0023808 | 5 | 73.8 | 0.046527 | 0.079429 | C | Study 1 | CV079 | 263 | 698 |
| 94 | NC0051419 | 5 | 73.8 | 0.023479 | -0.10937 | T | Study 1 | CV082 | 218 | 699 |
| 94 | NC0051419 | 5 | 73.8 | 0.031457 | -0.01099 | T | Study 1 | CV082 | 218 | 699 |
| 94 | NC0200092 | 5 | 73.8 | -- | -- | G | Study 5 | -- | 290 | 700 |
| 94 | NC0019187 | 5 | 74.1 | 0.004468 | -0.16908 | C | Study 1 | CV131 | 186 | 701 |
| 94 | NC0019187 | 5 | 74.1 | 0.029004 | -0.00801 | C | Study 1 | CV116 | 186 | 701 |
| 94 | NC0019187 | 5 | 74.1 | 0.029004 | -0.00801 | C | Study 1 | CV116 | 186 | 701 |
| 94 | NC0019187 | 5 | 74.1 | 0.018377 | 0.015368 | C | Study 1 | CV144 | 186 | 701 |
| 94 | NC0082146 | 5 | 75.4 | 0.004773 | 0.166674 | C | Study 1 | CV023 | 339 | 702 |
| 94 | NC0082146 | 5 | 75.4 | 0.045868 | 0.011502 | C | Study 1 | CV159 | 339 | 702 |
| 94 | NC0080028 | 5 | 76.6 | 0.015807 | 0.019519 | A | Study 1 | CV165 | 267 | 703 |
| 94 | NC0004605 | 5 | 78.5 | 0.026942 | 0.016471 | T | Study 1 | CV080 | 74 | 704 |
| 94 | NC0107061 | 5 | 79 | 0.004563 | 0.106146 | GTATGAA | Study 1 | CV082 | 239 | 705 |
| 94 | NC0107549 | 5 | 79 | -- | -- | T | Study 5 | -- | 371 | 706 |
| 94 | NC0110919 | 5 | 79 | 0.029721 | 0.137233 | T | Study 1 | CV073 | 334 | 707 |
| 94 | NC0110919 | 5 | 79 | 0.005459 | 0.018925 | C | Study 1 | CV112 | 334 | 707 |
| 94 | NC0111346 | 5 | 79 | 8.54E-14 | 0.209062 | C | Study 2 | -- | 366 | 708 |
| 94 | NC0146415 | 5 | 79.8 | -- | -- | G | Study 4 | -- | 336 | 709 |
| 94 | NC0146415 | 5 | 79.8 | 0.017394 | -0.06775 | A | Study 1 | CV082 | 336 | 709 |
| 95 | NC0077644 | 5 | 80.4 | 0.044926 | 0.022435 | C | Study 1 | CV165 | 255 | 710 |
| 95 | NC0077644 | 5 | 80.4 | 0.008524 | 0.025523 | C | Study 1 | CV165 | 255 | 710 |

CONT.

| QTL | Marker | Chr | pos | sig | effect | res allele | Mapping Study | Fav. Parent | SNP Position | SEQ ID |
|---|---|---|---|---|---|---|---|---|---|---|
| 95 | NC0105854 | 5 | 81.2 | -- | -- | G | Study 5 | -- | 347 | 711 |
| 95 | NC0018230 | 5 | 81.3 | -- | -- | T | Study 4 | -- | 322 | 712 |
| 95 | NC0048328 | 5 | 81.3 | -- | -- | T | Study 4 | -- | 115 | 713 |
| 95 | NC0022796 | 5 | 81.5 | -- | -- | G | Study 5 | -- | 199 | 714 |
| 95 | NC0022796 | 5 | 81.5 | 0.000456 | -0.27666 | G | Study 1 | CV044 | 199 | 714 |
| 95 | NC0027874 | 5 | 81.5 | -- | -- | T | Study 5 | -- | 344 | 715 |
| 95 | NC0019329 | 5 | 83.9 | -- | -- | C | Study 5 | -- | 341 | 716 |
| 95 | NC0078535 | 5 | 83.9 | -- | -- | G | Study 5 | -- | 104 | 717 |
| 95 | NC0078535 | 5 | 83.9 | 0.031826 | -0.01643 | A | Study 1 | CV039 | 104 | 717 |
| 95 | NC0078535 | 5 | 83.9 | 0.00341 | 0.176768 | G | Study 1 | CV023 | 104 | 717 |
| 95 | NC0040366 | 5 | 84.1 | 1.12E-12 | 0.201703 | C | Study 2 | -- | 119 | 718 |
| 95 | NC0040366 | 5 | 84.1 | -- | -- | C | Study 5 | -- | 119 | 718 |
| 95 | NC0040366 | 5 | 84.1 | 0.005605 | -0.01601 | C | Study 1 | CV088 | 119 | 718 |
| 95 | NC0040366 | 5 | 84.1 | 0.000041 | -0.01802 | A | Study 1 | CV095 | 119 | 718 |
| 95 | NC0040366 | 5 | 84.1 | 0.021556 | 0.212947 | A | Study 1 | CV130 | 119 | 718 |
| 95 | NC0035956 | 5 | 85.1 | -- | -- | C | Study 5 | -- | 246 | 719 |
| 95 | NC0035956 | 5 | 85.1 | 0.02236 | 0.01004 | C | Study 1 | CV012 | 246 | 719 |
| 95 | NC0035956 | 5 | 85.1 | 0.02882 | 0.076741 | C | Study 1 | CV126 | 246 | 719 |
| 95 | NC0035956 | 5 | 85.1 | 0.009458 | 0.018563 | A | Study 1 | CV165 | 246 | 719 |
| 95 | NC0035956 | 5 | 85.1 | 0.018427 | 0.024175 | C | Study 1 | CV120 | 246 | 719 |
| 95 | NC0154498 | 5 | 85.2 | 0.028937 | -0.01031 | G | Study 1 | CV088 | 84 | 720 |
| 95 | NC0040571 | 5 | 88.4 | 0.036245 | -0.11904 | G | Study 1 | CV131 | 154 | 721 |
| 95 | NC0040571 | 5 | 88.4 | 0.040548 | 0.089668 | G | Study 1 | CV116 | 154 | 721 |
| 95 | NC0040571 | 5 | 88.4 | 0.042321 | 0.102846 | G | Study 1 | CV118 | 154 | 721 |
| 95 | NC0040571 | 5 | 88.4 | 0.001551 | -0.08646 | G | Study 1 | CV050 | 154 | 721 |
| 95 | NC0040571 | 5 | 88.4 | 0.001004 | -0.0116 | C | Study 1 | CV080 | 154 | 721 |
| 95 | NC0040571 | 5 | 88.4 | 0.040493 | 0.017044 | G | Study 1 | CV165 | 154 | 721 |
| 95 | NC0040571 | 5 | 88.4 | 0.009112 | 0.154267 | G | Study 1 | CV070 | 154 | 721 |
| 95 | NC0040571 | 5 | 88.4 | 0.000154 | -0.01694 | G | Study 1 | CV095 | 154 | 721 |
| 95 | NC0040571 | 5 | 88.4 | 0.002735 | -0.08195 | C | Study 1 | CV144 | 154 | 721 |
| 95 | NC0040571 | 5 | 88.4 | 0.043209 | 0.013195 | G | Study 1 | I294213 | 154 | 721 |
| 95 | NC0110854 | 5 | 90.7 | 0.042512 | 0.009626 | G | Study 1 | CV069 | 337 | 722 |
| 96 | NC0027864 | 5 | 93.9 | 0.040733 | -0.05866 | T | Study 1 | CV082 | 176 | 723 |

CONT.

| QTL | Marker | Chr | pos | sig | effect | res allele | Mapping Study | Fav. Parent | SNP Position | SEQ ID |
|---|---|---|---|---|---|---|---|---|---|---|
| 96 | NC0027864 | 5 | 93.9 | 0.034426 | -0.01392 | C | Study 1 | CV095 | 176 | 723 |
| 96 | NC0053792 | 5 | 93.9 | -- | -- | T | Study 4 | -- | 384 | 724 |
| 96 | NC0053792 | 5 | 93.9 | 0.00233 | -0.01399 | T | Study 1 | CV095 | 384 | 724 |
| 96 | NC0002775 | 5 | 96 | 1.51E-11 | 0.188588 | G | Study 2 | -- | 372 | 725 |
| 96 | NC0111999 | 5 | 96.9 | -- | -- | G | Study 4 | -- | 587 | 726 |
| 96 | NC0018153 | 5 | 97 | 0.040563 | -0.00868 | G | Study 1 | CV088 | 573 | 727 |
| 96 | NC0018153 | 5 | 97 | 0.001553 | -0.08472 | A | Study 1 | CV011 | 573 | 727 |
| 96 | NC0018153 | 5 | 97 | 0.013525 | 0.144891 | G | Study 1 | CV070 | 573 | 727 |
| 96 | NC0018153 | 5 | 97 | 0.042985 | 0.073017 | G | Study 1 | CV126 | 573 | 727 |
| 96 | NC0048616 | 5 | 98.2 | 0.037756 | -0.01023 | C | Study 1 | CV088 | 88 | 728 |
| 96 | NC0173990 | 5 | 98.9 | -- | -- | T | Study 5 | -- | 438 | 729 |
| 96 | NC0012480 | 5 | 99.4 | 0.042805 | -0.11758 | A | Study 1 | CV131 | 137 | 730 |
| 96 | NC0012480 | 5 | 99.4 | 0.000953 | 0.036799 | C | Study 1 | CV165 | 137 | 730 |
| 96 | NC0012480 | 5 | 99.4 | 0.006982 | 0.026204 | C | Study 1 | CV165 | 137 | 730 |
| 96 | NC0036637 | 5 | 100 | 2.58E-12 | 0.20134 | T | Study 2 | -- | 699 | 731 |
| 97 | NC0199793 | 5 | 100 | -- | -- | A | Study 5 | -- | 92 | 732 |
| 97 | NC0017678 | 5 | 103.8 | 0.004666 | 0.017992 | A | Study 1 | CV159 | 171 | 733 |
| 97 | NC0009297 | 5 | 104.1 | 9.83E-13 | 0.197853 | A | Study 2 | -- | 114 | 734 |
| 97 | NC0009297 | 5 | 104.1 | 0.019225 | 0.024065 | A | Study 1 | CV120 | 114 | 734 |
| 97 | NC0009297 | 5 | 104.1 | 0.020441 | 0.014139 | A | Study 1 | CV117 | 114 | 734 |
| 97 | NC0003338 | 5 | 106.2 | 0.046093 | 0.092544 | C | Study 1 | CV118 | 324 | 735 |
| 97 | NC0003338 | 5 | 106.2 | 0.017526 | -0.00584 | C | Study 1 | CV088 | 324 | 735 |
| 97 | NC0003338 | 5 | 106.2 | 0.045399 | -0.08699 | C | Study 1 | CV111 | 324 | 735 |
| 97 | NC0003338 | 5 | 106.2 | 0.044603 | -0.01297 | A | Study 1 | CV063 | 324 | 735 |
| 97 | NC0038972 | 5 | 106.2 | 0.004529 | 0.318202 | A | Study 1 | CV124 | 539 | 736 |
| 97 | NC0038972 | 5 | 106.2 | 0.023623 | 0.015004 | A | Study 1 | CV144 | 539 | 736 |
| 97 | NC0078478 | 5 | 106.2 | 0.005979 | -0.14672 | T | Study 1 | I294213 | 686 | 737 |
| 97 | NC0106300 | 5 | 106.6 | -- | -- | * | Study 4 | -- | 329 | 738 |
| 98 | NC0107238 | 5 | 114.7 | 0.032885 | 0.126418 | A | Study 1 | CV070 | 375 | 739 |
| 98 | NC0008807 | 5 | 118.8 | -- | -- | T | Study 4 | -- | 282 | 740 |
| 98 | NC0008807 | 5 | 118.8 | 0.026115 | -0.00576 | C | Study 1 | CV088 | 282 | 740 |
| 98 | NC0008807 | 5 | 118.8 | 0.016457 | -0.02098 | C | Study 1 | I294213 | 282 | 740 |
| 98 | NC0008807 | 5 | 118.8 | 0.024583 | 0.059631 | C | Study 1 | CV112 | 282 | 740 |

CONT.

| QTL | Marker | Chr | pos | sig | effect | res allele | Mapping Study | Fav. Parent | SNP Position | SEQ ID |
|---|---|---|---|---|---|---|---|---|---|---|
| 98 | NC0008807 | 5 | 118.8 | 0.048147 | -0.00906 | C | Study 1 | CV095 | 282 | 740 |
| 99 | NC0005480 | 5 | 120 | 0.012229 | -0.01486 | A | Study 1 | CV112 | 174 | 741 |
| 99 | NC0016868 | 5 | 122.6 | 0.020135 | 0.07092 | G | Study 1 | CV131 | 331 | 742 |
| 99 | NC0016868 | 5 | 122.6 | 0.034532 | -0.01783 | C | Study 1 | CV064 | 331 | 742 |
| 99 | NC0016868 | 5 | 122.6 | 0.026989 | -0.00969 | G | Study 1 | CV109 | 331 | 742 |
| 99 | NC0016868 | 5 | 122.6 | 0.003376 | 0.018262 | C | Study 1 | CV159 | 331 | 742 |
| 99 | NC0017125 | 5 | 122.6 | -- | -- | T | Study 4 | -- | 38 | 743 |
| 99 | NC0017125 | 5 | 122.6 | 0.033895 | -0.09872 | T | Study 1 | CV069 | 38 | 743 |
| 99 | NC0083876 | 5 | 124 | 0.023509 | -0.06105 | C | Study 1 | CV050 | 513 | 744 |
| 99 | NC0083876 | 5 | 124 | 0.005552 | -0.06961 | T | Study 1 | I294213 | 513 | 744 |
| 99 | NC0106716 | 5 | 125 | 2.27E-11 | 0.189503 | A | Study 2 | -- | 470 | 745 |
| 99 | NC0106716 | 5 | 125 | 0.000264 | -0.10179 | G | Study 1 | CV011 | 470 | 745 |
| 99 | NC0106716 | 5 | 125 | 0.00216 | -0.01031 | G | Study 1 | CV080 | 470 | 745 |
| 99 | NC0106716 | 5 | 125 | 0.035748 | 0.123295 | G | Study 1 | CV070 | 470 | 745 |
| 99 | NC0106716 | 5 | 125 | 0.021732 | 0.011995 | G | Study 1 | -- | 470 | 745 |
| 99 | NC0106716 | 5 | 125 | 0.010074 | 0.210788 | A | Study 1 | CV125 | 470 | 745 |
| 99 | NC0106716 | 5 | 125 | 0.024155 | 0.025295 | G | Study 1 | CV165 | 470 | 745 |
| 99 | NC0106716 | 5 | 125 | 0.03505 | 0.020624 | G | Study 1 | CV165 | 470 | 745 |
| 99 | NC0009434 | 5 | 125.2 | 0.021574 | -0.12857 | A | Study 1 | CV131 | 123 | 746 |
| 99 | NC0009434 | 5 | 125.2 | 0.038011 | 0.095313 | A | Study 1 | CV116 | 123 | 746 |
| 99 | NC0009434 | 5 | 125.2 | 0.045736 | 0.00497 | G | Study 1 | -- | 123 | 746 |
| 99 | NC0009434 | 5 | 125.2 | 0.001277 | 0.156453 | A | Study 1 | CV118 | 123 | 746 |
| 99 | NC0009434 | 5 | 125.2 | 0.00265 | 0.018095 | A | Study 1 | CV117 | 123 | 746 |
| 99 | NC0199389 | 5 | 125.8 | -- | -- | G | Study 5 | -- | 299 | 747 |
| 99 | NC0010131 | 5 | 129.7 | 0.038207 | -0.18291 | T | Study 1 | I294213 | 154 | 748 |
| 99 | NC0010131 | 5 | 129.7 | 0.043775 | 0.057959 | C | Study 1 | CV050 | 154 | 748 |
| 99 | NC0035377 | 5 | 132.8 | 0.030109 | 0.014921 | C | Study 1 | CV144 | 67 | 749 |
| 99 | NC0199325 | 5 | 137.1 | -- | -- | T | Study 5 | -- | 69 | 750 |
| 100 | NC0081212 | 5 | 138.2 | 0.017999 | 0.10886 | G | Study 1 | CV118 | 571 | 751 |
| 100 | NC0154430 | 5 | 138.6 | -- | -- | G | Study 5 | -- | 244 | 752 |
| 100 | NC0154899 | 5 | 138.6 | 0.003571 | -0.0081 | A | Study 1 | CV088 | 208 | 753 |
| 100 | NC0154899 | 5 | 138.6 | 0.029741 | 0.057171 | A | Study 1 | CV112 | 208 | 753 |
| 100 | NC0154899 | 5 | 138.6 | 0.006522 | 0.030583 | T | Study 1 | CV165 | 208 | 753 |

CONT.

| QTL | Marker | Chr | pos | sig | effect | res allele | Mapping Study | Fav. Parent | SNP Position | SEQ ID |
|---|---|---|---|---|---|---|---|---|---|---|
| 100 | NC0154899 | 5 | 138.6 | 0.015836 | 0.023691 | T | Study 1 | CV165 | 208 | 753 |
| 100 | NC0085514 | 5 | 139.5 | 0.003 | -0.08259 | C | Study 3 | -- | 126 | 754 |
| 100 | NC0085514 | 5 | 139.5 | 0.003668 | 0.085429 | C | Study 1 | CV131 | 126 | 754 |
| 100 | NC0053779 | 5 | 143.8 | -- | -- | * | Study 4 | -- | 128 | 755 |
| 101 | NC0053779 | 5 | 143.8 | 0.000533 | 0.271906 | T | Study 1 | CV125 | 128 | 755 |
| 101 | NC0002353 | 5 | 144.7 | 3.23E-10 | 0.178028 | T | Study 2 | -- | 123 | 756 |
| 101 | NC0002353 | 5 | 144.7 | 0.004737 | 0.129085 | C | Study 1 | CV118 | 123 | 756 |
| 101 | NC0002353 | 5 | 144.7 | 0.008012 | -0.00904 | T | Study 1 | CV080 | 123 | 756 |
| 101 | NC0002353 | 5 | 144.7 | 0.002846 | 0.018558 | A | Study 1 | CV117 | 123 | 756 |
| 101 | NC0041824 | 5 | 144.7 | 0.039884 | -0.12298 | T | Study 1 | CV131 | 54 | 757 |
| 101 | NC0036210 | 5 | 145.2 | 0.016258 | 0.072667 | A | Study 1 | CV131 | 43 | 758 |
| 101 | NC0111944 | 5 | 148.1 | 0.036985 | -0.01277 | A | Study 1 | CV095 | 138 | 759 |
| 101 | NC0143380 | 5 | 148.1 | 0.033619 | 0.06041 | A | Study 1 | CV050 | 324 | 760 |
| 101 | NC0143380 | 5 | 148.1 | 0.000952 | 0.260294 | G | Study 1 | CV125 | 324 | 760 |
| 102 | NC0110484 | 5 | 159.5 | 0.028021 | 0.010439 | A | Study 1 | CV082 | 215 | 761 |
| 102 | NC0110484 | 5 | 159.5 | 0.036089 | -0.01839 | C | Study 1 | I294213 | 215 | 761 |
| 102 | NC0110484 | 5 | 159.5 | 0.049927 | -0.06966 | C | Study 1 | CV055 | 215 | 761 |
| 102 | NC0110484 | 5 | 159.5 | 0.004975 | 0.020117 | A | Study 1 | CV165 | 215 | 761 |
| 102 | NC0104963 | 5 | 159.8 | 0.005412 | 0.080748 | G | Study 1 | CV131 | 269 | 762 |
| 102 | NC0104963 | 5 | 159.8 | 0.041333 | 0.057004 | G | Study 1 | CV116 | 269 | 762 |
| 102 | NC0104963 | 5 | 159.8 | 0.048753 | -0.07455 | A | Study 1 | CV101 | 269 | 762 |
| 102 | NC0104963 | 5 | 159.8 | 0.014293 | 0.068322 | G | Study 1 | CV050 | 269 | 762 |
| 102 | NC0104963 | 5 | 159.8 | 0.029827 | -0.15911 | A | Study 1 | CV112 | 269 | 762 |
| 102 | NC0200099 | 5 | 171.1 | -- | -- | * | Study 5 | -- | 364 | 763 |
| 103 | NC0104717 | 5 | 171.2 | 0.00789 | 0.077357 | T | Study 2 | -- | 298 | 764 |
| 103 | NC0104717 | 5 | 171.2 | 0.006728 | -0.04594 | T | Study 1 | CV010 | 298 | 764 |
| 103 | NC0104717 | 5 | 171.2 | 0.005099 | -0.01142 | T | Study 1 | CV010 | 298 | 764 |
| 103 | NC0104717 | 5 | 171.2 | 0.023515 | 0.011898 | C | Study 1 | CV081 | 298 | 764 |
| 103 | NC0104717 | 5 | 171.2 | 0.039112 | 0.009123 | T | Study 1 | CV012 | 298 | 764 |
| 103 | NC0104717 | 5 | 171.2 | 0.039112 | 0.009123 | T | Study 1 | CV012 | 298 | 764 |
| 103 | NC0105546 | 5 | 171.7 | -- | -- | *** | Study 4 | -- | 104 | 765 |
| 103 | NC0105546 | 5 | 171.7 | 0.044333 | 0.012109 | AGC | Study 1 | CV013 | 104 | 765 |
| 103 | NC0109853 | 5 | 173.9 | -- | -- | ***** | Study 4 | -- | 512 | 766 |

CONT.

| QTL | Marker | Chr | pos | sig | effect | res allele | Mapping Study | Fav. Parent | SNP Position | SEQ ID |
|---|---|---|---|---|---|---|---|---|---|---|
| 103 | NC0109853 | 5 | 173.9 | 0.036777 | -0.19442 | ***** | Study 1 | CV088 | 512 | 766 |
| 103 | NC0109853 | 5 | 173.9 | 0.015247 | 0.065208 | CATTG | Study 1 | CV084 | 512 | 766 |
| 103 | NC0109853 | 5 | 173.9 | 0.04387 | 0.070389 | ***** | Study 1 | CV053 | 512 | 766 |
| 103 | NC0109853 | 5 | 173.9 | 0.023402 | -0.05971 | ***** | Study 1 | CV011 | 512 | 766 |
| 103 | NC0109853 | 5 | 173.9 | 0.011888 | -0.02129 | CATTG | Study 1 | I294213 | 512 | 766 |
| 103 | NC0109853 | 5 | 173.9 | 0.04679 | 0.107478 | ***** | Study 1 | CV149 | 512 | 766 |
| 103 | NC0109853 | 5 | 173.9 | 0.006098 | -0.00775 | ***** | Study 1 | CV138 | 512 | 766 |
| 103 | NC0109853 | 5 | 173.9 | 0.007444 | -0.09519 | CATTG | Study 1 | CV055 | 512 | 766 |
| 103 | NC0021585 | 5 | 175 | 0.012068 | 0.107882 | G | Study 1 | CV118 | 233 | 767 |
| 103 | NC0021585 | 5 | 175 | 0.00396 | 0.013704 | C | Study 1 | CV082 | 233 | 767 |
| 103 | NC0021585 | 5 | 175 | 0.038277 | 0.046828 | C | Study 1 | CV074 | 233 | 767 |
| 103 | NC0021585 | 5 | 175 | 0.004712 | 0.020348 | C | Study 1 | CV074 | 233 | 767 |
| 103 | NC0012417 | 5 | 175.2 | 0.0255 | 0.013991 | T | Study 1 | CV013 | 137 | 768 |
| 103 | NC0000015 | 5 | 175.3 | 0.008072 | 0.029513 | C | Study 1 | CV165 | 373 | 769 |
| 103 | NC0000015 | 5 | 175.3 | 0.018155 | 0.022958 | C | Study 1 | CV165 | 373 | 769 |
| 103 | NC0200212 | 5 | 176.4 | -- | -- | T | Study 5 | -- | 395 | 770 |
| 103 | NC0025270 | 5 | 177.8 | 0.001689 | 0.114529 | T | Study 1 | CV053 | 389 | 771 |
| 103 | NC0025270 | 5 | 177.8 | 0.046227 | -0.03578 | G | Study 1 | CV010 | 389 | 771 |
| 103 | NC0025270 | 5 | 177.8 | 0.020611 | -0.01026 | G | Study 1 | CV010 | 389 | 771 |
| 103 | NC0025270 | 5 | 177.8 | 0.036174 | -0.01226 | G | Study 1 | CV093 | 389 | 771 |
| 103 | NC0111504 | 5 | 181 | 0.039978 | 0.011803 | T | Study 1 | CV159 | 712 | 772 |
| 103 | NC0031084 | 5 | 181.5 | 0.001485 | 0.014991 | G | Study 1 | CV082 | 53 | 773 |
| 103 | NC0199113 | 5 | 183.1 | 0.047865 | -0.01488 | C | Study 1 | CV112 | 120 | 774 |
| 103 | NC0175477 | 5 | 183.6 | -- | -- | T | Study 5 | -- | 297 | 775 |
| 103 | NC0113237 | 5 | 184.1 | -- | -- | G | Study 5 | -- | 657 | 776 |
| 104 | NC0108746 | 6 | 24.5 | -- | -- | G | Study 5 | -- | 330 | 777 |
| 104 | NC0014417 | 6 | 25 | -- | -- | G | Study 4 | -- | 208 | 778 |
| 105 | NC0014417 | 6 | 25 | 0.045214 | 0.105366 | A | Study 1 | CV069 | 208 | 778 |
| 105 | NC0014417 | 6 | 25 | 0.032858 | 0.171458 | A | Study 1 | CV132 | 208 | 778 |
| 105 | NC0014417 | 6 | 25 | 0.006327 | 0.095526 | A | Study 1 | CV162 | 208 | 778 |
| 105 | NC0027615 | 6 | 25.5 | 0.016903 | -0.14787 | * | Study 1 | CV017 | 236 | 779 |
| 105 | NC0027615 | 6 | 25.5 | 0.017416 | -0.07086 | * | Study 1 | CV100 | 236 | 779 |
| 105 | NC0027615 | 6 | 25.5 | 0.020169 | -0.10191 | * | Study 1 | CV100 | 236 | 779 |

CONT.

| QTL | Marker | Chr | pos | sig | effect | res allele | Mapping Study | Fav. Parent | SNP Position | SEQ ID |
|---|---|---|---|---|---|---|---|---|---|---|
| 105 | NC0027615 | 6 | 25.5 | 0.010546 | 0.011145 | T | Study 1 | CV169 | 236 | 779 |
| 105 | NC0105014 | 6 | 28.8 | 0.000043 | -0.09171 | C | Study 1 | CV022 | 348 | 780 |
| 106 | NC0077806 | 6 | 32.4 | -- | -- | T | Study 5 | -- | 86 | 781 |
| 106 | NC0199605 | 6 | 32.4 | -- | -- | T | Study 5 | -- | 345 | 782 |
| 106 | NC0153811 | 6 | 33.2 | 0.045604 | 0.003808 | A | Study 1 | CV113 | 98 | 783 |
| 106 | NC0153811 | 6 | 33.2 | 0.002424 | -0.01561 | A | Study 1 | CV087 | 98 | 783 |
| 106 | NC0066735 | 6 | 34.3 | 0.013467 | -0.10509 | C | Study 1 | CV040 | 564 | 784 |
| 106 | NC0200061 | 6 | 34.4 | -- | -- | C | Study 5 | -- | 334 | 785 |
| 106 | NC0013985 | 6 | 35.4 | 0.025269 | -0.01672 | A | Study 1 | CV039 | 132 | 786 |
| 106 | NC0033924 | 6 | 36.2 | 0.048558 | -0.08139 | C | Study 2 | -- | 93 | 787 |
| 106 | NC0033924 | 6 | 36.2 | -- | -- | C | Study 5 | -- | 93 | 787 |
| 106 | NC0042917 | 6 | 36.4 | -- | -- | C | Study 5 | -- | 67 | 788 |
| 106 | NC0069630 | 6 | 36.5 | 0.017027 | -0.02663 | A | Study 1 | CV121 | 597 | 789 |
| 106 | NC0069630 | 6 | 36.5 | 0.010676 | -0.02478 | A | Study 1 | CV121 | 597 | 789 |
| 106 | NC0069630 | 6 | 36.5 | 0.012692 | -0.01671 | A | Study 1 | CV017 | 597 | 789 |
| 106 | NC0105714 | 6 | 36.7 | -- | -- | G | Study 5 | -- | 363 | 790 |
| 106 | NC0002870 | 6 | 38.4 | 0.000124 | -0.11532 | T | Study 2 | -- | 398 | 791 |
| 106 | NC0002870 | 6 | 38.4 | 0.032331 | -0.12585 | G | Study 1 | I294213 | 398 | 791 |
| 106 | NC0002870 | 6 | 38.4 | 0.01878 | -0.01521 | G | Study 1 | CV113 | 398 | 791 |
| 106 | NC0003210 | 6 | 38.4 | -- | -- | G | Study 5 | -- | 117 | 792 |
| 106 | NC0025657 | 6 | 38.4 | <.0001 | -0.16425 | C | Study 3 | -- | 250 | 793 |
| 106 | NC0025657 | 6 | 38.4 | -- | -- | T | Study 5 | -- | 250 | 793 |
| 106 | NC0026803 | 6 | 38.4 | <.0001 | -0.3015 | C | Study 3 | -- | 410 | 794 |
| 106 | NC0026803 | 6 | 38.4 | 0.015529 | -0.20559 | C | Study 1 | CV071 | 410 | 794 |
| 106 | NC0029828 | 6 | 38.4 | -- | -- | T | Study 5 | -- | 301 | 795 |
| 106 | NC0030875 | 6 | 38.4 | -- | -- | T | Study 4 | -- | 335 | 796 |
| 106 | NC0030875 | 6 | 38.4 | 0.048601 | -0.01617 | C | Study 5 | -- | 335 | 796 |
| 106 | NC0030875 | 6 | 38.4 | -- | -- | T | Study 1 | CV017 | 335 | 796 |
| 106 | NC0042090 | 6 | 38.4 | -- | -- | G | Study 5 | -- | 119 | 797 |
| 106 | NC0068941 | 6 | 38.4 | -- | -- | C | Study 5 | -- | 278 | 798 |
| 106 | NC0069532 | 6 | 38.4 | <.0001 | 0.322042 | T | Study 3 | -- | 54 | 799 |
| 106 | NC0082439 | 6 | 38.4 | -- | -- | G | Study 5 | -- | 381 | 800 |
| 106 | NC0107287 | 6 | 38.4 | -- | -- | -- | -- | -- | 278 | 801 |

CONT.

| QTL | Marker | Chr | pos | sig | effect | res allele | Mapping Study | Fav. Parent | SNP Position | SEQ ID |
|---|---|---|---|---|---|---|---|---|---|---|
| 106 | NC0107639 | 6 | 38.4 | 0.004862 | -0.22817 | T | Study 1 | CV071 | 206 | 802 |
| 106 | NC0173606 | 6 | 38.4 | -- | -- | G | Study 5 | -- | 700 | 803 |
| 106 | NC0173900 | 6 | 38.4 | -- | -- | T | Study 5 | -- | 885 | 804 |
| 106 | NC0195587 | 6 | 38.4 | 0.11405 | 0.020232 | G | Study 5 | -- | 94 | 805 |
| 106 | NC0110607 | 6 | 38.7 | 0.000584 | -0.10709 | T | Study 2 | -- | 468 | 806 |
| 106 | NC0110607 | 6 | 38.7 | -- | -- | T | Study 5 | -- | 468 | 806 |
| 106 | NC0110607 | 6 | 38.7 | 0.000053 | -0.09395 | G | Study 1 | CV022 | 468 | 806 |
| 106 | NC0110607 | 6 | 38.7 | 0.004659 | -0.17609 | G | Study 1 | CV017 | 468 | 806 |
| 106 | NC0110607 | 6 | 38.7 | 0.000599 | -0.01722 | G | Study 1 | CV087 | 468 | 806 |
| 106 | NC0027095 | 6 | 38.8 | -- | -- | G | Study 4 | -- | 259 | 807 |
| 106 | NC0027095 | 6 | 38.8 | 0.001713 | -0.14448 | G | Study 1 | I294213 | 259 | 807 |
| 106 | NC0027095 | 6 | 38.8 | 0.000208 | -0.15721 | A | Study 1 | CV040 | 259 | 807 |
| 106 | NC0027095 | 6 | 38.8 | 0.019586 | 0.187809 | A | Study 1 | CV132 | 259 | 807 |
| 106 | NC0027095 | 6 | 38.8 | 0.036225 | 0.025391 | A | Study 1 | CV132 | 259 | 807 |
| 106 | NC0027095 | 6 | 38.8 | 0.040489 | -0.00878 | G | Study 1 | CV109 | 259 | 807 |
| 106 | NC0027095 | 6 | 38.8 | 0.010238 | -0.02862 | G | Study 1 | CV121 | 259 | 807 |
| 106 | NC0027095 | 6 | 38.8 | 0.002924 | -0.02878 | G | Study 1 | CV121 | 259 | 807 |
| 106 | NC0110850 | 6 | 39.3 | 0.007236 | -0.00781 | C | Study 1 | CV115 | 430 | 808 |
| 106 | NC0025201 | 6 | 39.4 | -- | -- | G | Study 4 | -- | 455 | 809 |
| 106 | NC0025201 | 6 | 39.4 | -- | -- | G | Study 5 | -- | 455 | 809 |
| 106 | NC0147740 | 6 | 39.4 | -- | -- | G | Study 4 | -- | 916 | 810 |
| 106 | NC0147740 | 6 | 39.4 | -- | -- | G | Study 5 | -- | 916 | 810 |
| 106 | NC0199945 | 6 | 39.4 | -- | -- | T | Study 5 | -- | 485 | 811 |
| 106 | NC0000439 | 6 | 39.9 | 0.005776 | -0.08761 | C | Study 1 | CV064 | 235 | 812 |
| 107 | NC0036067 | 6 | 41 | -- | -- | T | Study 4 | -- | 129 | 813 |
| 107 | NC0036073 | 6 | 41 | -- | -- | T | Study 4 | -- | 388 | 814 |
| 107 | NC0147437 | 6 | 41.2 | -- | -- | T | Study 4 | -- | 466 | 815 |
| 107 | NC0037981 | 6 | 44.2 | -- | -- | G | Study 5 | -- | 286 | 816 |
| 107 | NC0199296 | 6 | 44.6 | -- | -- | G | Study 5 | -- | 266 | 817 |
| 107 | NC0034560 | 6 | 45.7 | -- | -- | G | Study 5 | -- | 680 | 818 |
| 107 | NC0030176 | 6 | 48 | -- | -- | T | Study 4 | -- | 731 | 819 |
| 107 | NC0030176 | 6 | 48 | 0.021089 | -0.0184 | T | Study 1 | CV017 | 731 | 819 |
| 107 | NC0106121 | 6 | 49.2 | 0.006782 | -0.30063 | C | Study 1 | CV112 | 288 | 820 |

CONT.

| QTL | Marker | Chr | pos | sig | effect | res allele | Mapping Study | Fav. Parent | SNP Position | SEQ ID |
|---|---|---|---|---|---|---|---|---|---|---|
| 107 | NC0106121 | 6 | 49.2 | 0.001916 | -0.01327 | C | Study 1 | CV109 | 288 | 820 |
| 107 | NC0106121 | 6 | 49.2 | 0.039963 | 0.011896 | C | Study 1 | CV069 | 288 | 820 |
| 108 | NC0038040 | 6 | 52.1 | -- | -- | G | Study 4 | -- | 382 | 821 |
| 108 | NC0038040 | 6 | 52.1 | 0.010735 | 0.011775 | A | Study 1 | CV108 | 382 | 821 |
| 108 | NC0038040 | 6 | 52.1 | 0.044382 | -0.01324 | A | Study 1 | CV040 | 382 | 821 |
| 108 | NC0034523 | 6 | 53.2 | 0.000092 | -0.1621 | A | Study 1 | CV121 | 200 | 822 |
| 108 | NC0034054 | 6 | 53.4 | 0.00502 | -0.02739 | ****** | Study 1 | I294213 | 129 | 823 |
| 108 | NC0106527 | 6 | 56.4 | 0.031593 | -0.0994 | G | Study 1 | CV022 | 356 | 824 |
| 108 | NC0106527 | 6 | 56.4 | 0.004027 | -0.0629 | G | Study 1 | CV084 | 356 | 824 |
| 108 | NC0106527 | 6 | 56.4 | 0.046527 | 0.054307 | G | Study 1 | I294213 | 356 | 824 |
| 108 | NC0106527 | 6 | 56.4 | 0.00828 | -0.17847 | G | Study 1 | CV109 | 356 | 824 |
| 108 | NC0106527 | 6 | 56.4 | 0.001497 | -0.01351 | G | Study 1 | CV116 | 356 | 824 |
| 108 | NC0004463 | 6 | 56.5 | 0.04077 | 0.054509 | T | Study 1 | CV064 | 263 | 825 |
| 108 | NC0004463 | 6 | 56.5 | 0.001655 | -0.09923 | T | Study 1 | CV115 | 263 | 825 |
| 108 | NC0004463 | 6 | 56.5 | 0.046343 | -0.0058 | C | Study 1 | -- | 263 | 825 |
| 108 | NC0031945 | 6 | 56.6 | 0.000153 | -0.11039 | C | Study 2 | -- | 416 | 826 |
| 108 | NC0060751 | 6 | 56.6 | -- | -- | G | Study 5 | -- | 297 | 827 |
| 108 | NC0060751 | 6 | 56.6 | 0.011905 | 0.089311 | A | Study 1 | CV079 | 297 | 827 |
| 108 | NC0060751 | 6 | 56.6 | 0.012575 | 0.098597 | A | Study 1 | CV079 | 297 | 827 |
| 108 | NC0057758 | 6 | 57.5 | -- | -- | G | Study 4 | -- | 46 | 828 |
| 108 | NC0057758 | 6 | 57.5 | 0.020586 | -0.01495 | A | Study 1 | CV113 | 46 | 828 |
| 108 | NC0032034 | 6 | 57.6 | 0.001684 | -0.0873 | A | Study 2 | -- | 498 | 829 |
| 109 | NC0011591 | 6 | 60.5 | 4.19E-05 | -0.11893 | C | Study 2 | -- | 187 | 830 |
| 109 | NC0011591 | 6 | 60.5 | 0.001982 | 0.144404 | T | Study 1 | CV013 | 187 | 830 |
| 109 | NC0011591 | 6 | 60.5 | 0.027888 | 0.054718 | T | Study 1 | CV168 | 187 | 830 |
| 109 | NC0146195 | 6 | 66 | -- | -- | G | Study 4 | -- | 345 | 831 |
| 109 | NC0146195 | 6 | 66 | 0.00766 | 0.250899 | C | Study 1 | CV109 | 345 | 831 |
| 109 | NC0059008 | 6 | 66.2 | 0.000308 | -0.10416 | T | Study 2 | -- | 83 | 832 |
| 109 | NC0059008 | 6 | 66.2 | -- | -- | T | Study 5 | -- | 83 | 832 |
| 109 | NC0003277 | 6 | 69.4 | 0.001946 | 0.020276 | C | Study 1 | I283669 | 84 | 833 |
| 109 | NC0003277 | 6 | 69.4 | 0.001623 | -0.01354 | T | Study 1 | CV109 | 84 | 833 |
| 109 | NC0196774 | 6 | 69.4 | -- | -- | G | Study 5 | -- | 164 | 834 |
| 110 | NC0148039 | 6 | 70.2 | -- | -- | T | Study 4 | -- | 76 | 835 |

CONT.

| QTL | Marker | Chr | pos | sig | effect | res allele | Mapping Study | Fav. Parent | SNP Position | SEQ ID |
|---|---|---|---|---|---|---|---|---|---|---|
| 110 | NC0148039 | 6 | 70.2 | 0.028916 | -0.07496 | T | Study 1 | CV041 | 76 | 835 |
| 110 | NC0148039 | 6 | 70.2 | 0.029498 | -0.07395 | T | Study 1 | CV017 | 76 | 835 |
| 110 | NC0008833 | 6 | 70.9 | 0.000515 | -0.10036 | C | Study 2 | -- | 411 | 836 |
| 110 | NC0008833 | 6 | 70.9 | 0.00076 | -0.14223 | A | Study 1 | CV040 | 411 | 836 |
| 110 | NC0008833 | 6 | 70.9 | 0.001288 | -0.10173 | A | Study 1 | CV064 | 411 | 836 |
| 110 | NC0014694 | 6 | 77.7 | <.0001 | -0.14263 | A | Study 3 | -- | 293 | 837 |
| 110 | NC0014694 | 6 | 77.8 | -- | -- | C | Study 4 | -- | 105 | 838 |
| 110 | NC0014694 | 6 | 77.8 | 0.033009 | -0.00354 | A | Study 1 | CV010 | 105 | 838 |
| 110 | NC0014694 | 6 | 77.8 | 0.042307 | -0.10126 | A | Study 1 | 1294213 | 105 | 838 |
| 110 | NC0014694 | 6 | 77.8 | 0.037399 | -0.08549 | C | Study 1 | CV045 | 105 | 838 |
| 110 | NC0014694 | 6 | 77.8 | 0.006246 | 0.096863 | C | Study 1 | CV079 | 105 | 838 |
| 110 | NC0014694 | 6 | 77.8 | 0.000304 | 0.141184 | C | Study 1 | CV079 | 105 | 838 |
| 110 | NC0014694 | 6 | 77.8 | 0.046772 | 0.010649 | C | Study 1 | CV007 | 105 | 838 |
| 110 | NC0005064 | 6 | 78.1 | -- | -- | G | Study 5 | -- | 174 | 839 |
| 110 | NC0005066 | 6 | 78.1 | 0.030004 | -0.12874 | G | Study 1 | CV131 | 283 | 840 |
| 110 | NC0005066 | 6 | 78.1 | 0.022097 | 0.0828 | C | Study 1 | CV109 | 283 | 840 |
| 110 | NC0005066 | 6 | 78.1 | 0.001533 | -0.40195 | G | Study 1 | CV112 | 283 | 840 |
| 110 | NC0005066 | 6 | 78.1 | 0.044336 | 0.023551 | C | Study 1 | CV058 | 283 | 840 |
| 110 | NC0005066 | 6 | 78.1 | 0.040902 | 0.017223 | C | Study 1 | CV161 | 283 | 840 |
| 110 | NC0019518 | 6 | 78.5 | 0.000434 | -0.1028 | T | Study 2 | -- | 375 | 841 |
| 110 | NC0019518 | 6 | 78.5 | 0.001648 | -0.01647 | T | Study 1 | CV086 | 375 | 841 |
| 110 | NC0077031 | 6 | 78.8 | 0.000662 | -0.01732 | G | Study 1 | CV087 | 105 | 842 |
| 110 | NC0005081 | 6 | 79.3 | 0.0004 | 0.187754 | G | Study 3 | -- | 102 | 843 |
| 110 | NC0082021 | 6 | 79.6 | <.0001 | 0.180548 | ****** | Study 3 | -- | 375 | 844 |
| 110 | NC0082021 | 6 | 79.6 | 0.009276 | 0.072698 | CAGGGG | Study 1 | CV116 | 375 | 844 |
| 110 | NC0082021 | 6 | 79.6 | 0.001889 | 0.256305 | CAGGGG | Study 1 | CV125 | 375 | 844 |
| 110 | NC0108196 | 6 | 79.8 | <.0001 | -0.1394 | C | Study 3 | -- | 119 | 845 |
| 110 | NC0108196 | 6 | 79.8 | -- | -- | T | Study 4 | -- | 119 | 845 |
| 110 | NC0108196 | 6 | 79.8 | 0.008691 | 0.128029 | C | Study 1 | CV013 | 119 | 845 |
| 110 | NC0108196 | 6 | 79.8 | 0.016018 | 0.029521 | C | Study 1 | CV132 | 119 | 845 |
| 110 | NC0108196 | 6 | 79.8 | 0.014183 | 0.020438 | C | Study 1 | CV069 | 119 | 845 |
| 110 | NC0108196 | 6 | 79.8 | 0.014233 | -0.01637 | T | Study 1 | CV113 | 119 | 845 |
| 111 | NC0066737 | 6 | 81.9 | 0.029161 | -0.07274 | A | Study 1 | CV041 | 281 | 846 |

CONT.

| QTL | Marker | Chr | pos | sig | effect | res allele | Mapping Study | Fav. Parent | SNP Position | SEQ ID |
|---|---|---|---|---|---|---|---|---|---|---|
| 111 | NC0084789 | 6 | 82.2 | 0.006497 | 0.244015 | T | Study 1 | CV109 | 464 | 847 |
| 111 | NC0084789 | 6 | 82.2 | 0.000752 | -0.13836 | C | Study 1 | CV040 | 464 | 847 |
| 111 | NC0145427 | 6 | 82.2 | -- | -- | G | Study 4 | -- | 168 | 848 |
| 111 | NC0145427 | 6 | 82.2 | -- | -- | G | Study 5 | -- | 168 | 848 |
| 111 | NC0013638 | 6 | 83.5 | 8.77E-05 | -0.11275 | G | Study 2 | -- | 213 | 849 |
| 111 | NC0113381 | 6 | 83.8 | 0.048367 | -0.06296 | G | Study 1 | CV064 | 303 | 850 |
| 111 | NC0113381 | 6 | 83.8 | 0.028475 | 0.010983 | A | Study 1 | -- | 303 | 850 |
| 111 | NC0037517 | 6 | 84.9 | 0.019362 | -0.04749 | A | Study 1 | CV042 | 449 | 851 |
| 111 | NC0037517 | 6 | 84.9 | 0.001933 | -0.01623 | A | Study 1 | CV086 | 449 | 851 |
| 111 | NC0037517 | 6 | 84.9 | 0.001208 | -0.01731 | A | Study 1 | CV087 | 449 | 851 |
| 111 | NC0028203 | 6 | 85 | 0.001075 | -0.01776 | A | Study 1 | CV087 | 235 | 852 |
| 111 | NC0004030 | 6 | 85.5 | 0.000479 | -0.1027 | G | Study 2 | -- | 312 | 853 |
| 111 | NC0004030 | 6 | 85.5 | 0.009819 | -0.05237 | G | Study 1 | CV042 | 312 | 853 |
| 111 | NC0004030 | 6 | 85.5 | 0.045228 | -0.04693 | G | Study 1 | CV022 | 312 | 853 |
| 111 | NC0040364 | 6 | 85.5 | 0.005666 | 0.075044 | G | Study 1 | CV084 | 258 | 854 |
| 111 | NC0040364 | 6 | 85.5 | 0.003055 | 0.081265 | A | Study 1 | CV116 | 258 | 854 |
| 111 | NC0015070 | 6 | 91.7 | -- | -- | G | Study 5 | -- | 99 | 855 |
| 112 | NC0019772 | 6 | 92.4 | 0.003814 | -0.36712 | T | Study 1 | CV112 | 323 | 856 |
| 112 | NC0019772 | 6 | 92.4 | 0.013204 | 0.08795 | C | Study 1 | CV079 | 323 | 856 |
| 112 | NC0019772 | 6 | 92.4 | 0.000205 | 0.144982 | C | Study 1 | CV079 | 323 | 856 |
| 112 | NC0110972 | 6 | 93.2 | -- | -- | G | Study 4 | -- | 49 | 857 |
| 112 | NC0110972 | 6 | 93.2 | 0.001241 | 0.303679 | G | Study 1 | CV109 | 49 | 857 |
| 112 | NC0110972 | 6 | 93.2 | 0.015217 | 0.019871 | G | Study 1 | CV069 | 49 | 857 |
| 112 | NC0019588 | 6 | 96.7 | 0.003064 | -0.13454 | T | Study 1 | CV040 | 361 | 858 |
| 112 | NC0019588 | 6 | 96.7 | 0.029373 | 0.027144 | C | Study 1 | CV132 | 361 | 858 |
| 112 | NC0107703 | 6 | 96.7 | -- | -- | G | Study 5 | -- | 196 | 859 |
| 112 | NC0037947 | 6 | 97.6 | -- | -- | G | Study 4 | -- | 87 | 860 |
| 112 | NC0037947 | 6 | 97.6 | 0.001159 | 0.027316 | G | Study 1 | CV161 | 87 | 860 |
| 112 | NC0037947 | 6 | 97.6 | 0.030779 | 0.025177 | A | Study 1 | CV058 | 87 | 860 |
| 112 | NC0037947 | 6 | 97.6 | 0.038051 | 0.017217 | G | Study 1 | CV069 | 87 | 860 |
| 112 | NC0067075 | 6 | 98.9 | 0.046811 | -0.07042 | C | Study 1 | CV041 | 449 | 861 |
| 112 | NC0067075 | 6 | 98.9 | 0.046496 | 0.030867 | C | Study 1 | CV066 | 449 | 861 |
| 112 | NC0067075 | 6 | 98.9 | 0.028365 | 0.010855 | G | Study 1 | -- | 449 | 861 |

CONT.

| QTL | Marker | Chr | pos | sig | effect | res allele | Mapping Study | Fav. Parent | SNP Position | SEQ ID |
|---|---|---|---|---|---|---|---|---|---|---|
| 112 | NC0088767 | 6 | 99 | 0.001614 | -0.09321 | C | Study 2 | -- | 536 | 862 |
| 112 | NC0005319 | 6 | 99.1 | 0.016 | -0.19278 | A | Study 1 | CV069 | 476 | 863 |
| 112 | NC0005319 | 6 | 99.1 | 0.001289 | -0.01686 | A | Study 1 | CV086 | 476 | 863 |
| 112 | NC0005319 | 6 | 99.1 | 0.000027 | 0.32716 | G | Study 1 | CV125 | 476 | 863 |
| 113 | NC0017860 | 6 | 103.5 | 0.000036 | 0.372952 | A | Study 1 | CV109 | 87 | 864 |
| 113 | NC0017860 | 6 | 103.5 | 0.012963 | 0.134631 | A | Study 1 | CV013 | 87 | 864 |
| 113 | NC0017860 | 6 | 103.5 | 0.008018 | -0.1076 | C | Study 1 | CV045 | 87 | 864 |
| 113 | NC0081121 | 6 | 104.4 | -- | -- | G | Study 5 | -- | 320 | 865 |
| 113 | NC0059114 | 6 | 105.9 | -- | -- | T | Study 4 | -- | 511 | 866 |
| 113 | NC0059114 | 6 | 105.9 | 0.000531 | -0.06652 | T | Study 1 | CV042 | 511 | 866 |
| 113 | NC0059114 | 6 | 105.9 | 0.034258 | 0.006562 | A | Study 1 | CV082 | 511 | 866 |
| 113 | NC0059114 | 6 | 105.9 | 0.016226 | -0.10082 | A | Study 1 | CV040 | 511 | 866 |
| 113 | NC0059114 | 6 | 105.9 | 0.003247 | 0.115069 | T | Study 1 | CV079 | 511 | 866 |
| 113 | NC0146215 | 6 | 106.6 | 0.003298 | -0.16595 | C | Study 1 | CV131 | 217 | 867 |
| 113 | NC0146215 | 6 | 106.6 | 0.001069 | 0.094102 | C | Study 1 | CV116 | 217 | 867 |
| 113 | NC0146215 | 6 | 106.6 | 0.021072 | 0.02843 | C | Study 1 | CV132 | 217 | 867 |
| 113 | NC0029924 | 6 | 109.2 | 0.033411 | 0.010365 | T | Study 1 | CV082 | 176 | 868 |
| 113 | NC0029924 | 6 | 109.2 | 0.011501 | 0.068218 | T | Study 1 | CV084 | 176 | 868 |
| 113 | NC0029924 | 6 | 109.2 | 0.029564 | -0.05202 | C | Study 1 | CV022 | 176 | 868 |
| 113 | NC0029924 | 6 | 109.2 | 0.044308 | -0.07514 | C | Study 1 | CV017 | 176 | 868 |
| 113 | NC0029924 | 6 | 109.2 | 0.046698 | -0.0031 | C | Study 1 | CV010 | 176 | 868 |
| 113 | NC0029924 | 6 | 109.2 | 0.046698 | -0.0031 | C | Study 1 | CV010 | 176 | 868 |
| 113 | NC0002628 | 6 | 109.6 | 0.026588 | 0.120868 | C | Study 1 | CV149 | 120 | 869 |
| 114 | NC0054780 | 6 | 111.7 | 0.0007 | 0.107082 | T | Study 3 | -- | 477 | 870 |
| 114 | NC0054780 | 6 | 111.7 | -- | -- | T | Study 4 | -- | 477 | 870 |
| 114 | NC0054780 | 6 | 111.7 | 0.000479 | 0.314452 | T | Study 1 | CV109 | 477 | 870 |
| 114 | NC0054780 | 6 | 111.7 | 0.042561 | 0.009282 | T | Study 1 | CV013 | 477 | 870 |
| 114 | NC0054780 | 6 | 111.7 | 0.007898 | 0.013587 | T | Study 1 | CV069 | 477 | 870 |
| 114 | NC0031684 | 6 | 114.5 | -- | -- | T | Study 4 | -- | 252 | 871 |
| 114 | NC0031684 | 6 | 114.5 | 0.027686 | -0.01399 | T | Study 1 | CV108 | 252 | 871 |
| 114 | NC0031026 | 6 | 118 | 0.04032 | 0.011692 | * | Study 1 | CV150 | 326 | 872 |
| 114 | NC0107449 | 6 | 118.1 | 0.00461 | 0.016176 | T | Study 1 | I283669 | 285 | 873 |
| 115 | NC0023358 | 6 | 120.8 | 0.042831 | 0.090632 | A | Study 1 | CV013 | 177 | 874 |

CONT.

| QTL | Marker | Chr | pos | sig | effect | res allele | Mapping Study | Fav. Parent | SNP Position | SEQ ID |
|---|---|---|---|---|---|---|---|---|---|---|
| 115 | NC0023358 | 6 | 120.8 | 0.002271 | -0.10673 | A | Study 1 | CV041 | 177 | 874 |
| 115 | NC0023358 | 6 | 120.8 | 0.044157 | 0.177117 | A | Study 1 | CV125 | 177 | 874 |
| 115 | NC0003201 | 6 | 127.9 | 0.012216 | 0.22436 | G | Study 1 | CV109 | 74 | 875 |
| 115 | NC0003201 | 6 | 127.9 | 0.043765 | -0.01449 | G | Study 1 | CV017 | 74 | 875 |
| 115 | NC0003201 | 6 | 127.9 | 0.025597 | 0.006504 | G | Study 1 | CV109 | 74 | 875 |
| 115 | NC0003201 | 6 | 127.9 | 0.034669 | -0.014 | G | Study 1 | CV108 | 74 | 875 |
| 116 | NC0028185 | 6 | 130.1 | 0.022106 | -0.06756 | G | Study 2 | -- | 523 | 876 |
| 116 | NC0028185 | 6 | 130.1 | 0.036012 | 0.053674 | G | Study 1 | CV112 | 523 | 876 |
| 116 | NC0060514 | 6 | 131.2 | 0.019808 | -0.01729 | * * | Study 1 | CV039 | 264 | 877 |
| 116 | NC0060514 | 6 | 131.2 | 0.000397 | -0.07039 | CA | Study 1 | CV042 | 264 | 877 |
| 116 | NC0060514 | 6 | 131.2 | 0.033421 | 0.060061 | CA | Study 1 | CV116 | 264 | 877 |
| 116 | NC0060514 | 6 | 131.2 | 0.014878 | -0.05563 | CA | Study 1 | CV022 | 264 | 877 |
| 116 | NC0060514 | 6 | 131.2 | 0.001088 | -0.1157 | * * | Study 1 | CV041 | 264 | 877 |
| 116 | NC0060514 | 6 | 131.2 | 0.020466 | 0.097779 | * * | Study 1 | CV118 | 264 | 877 |
| 116 | NC0058629 | 6 | 131.3 | -- | -- | T | Study 4 | -- | 256 | 878 |
| 116 | NC0037634 | 6 | 132.4 | 0.046553 | 0.016822 | T | Study 1 | -- | 541 | 879 |
| 116 | NC0032509 | 6 | 132.9 | 0.028695 | 0.049476 | A | Study 1 | CV074 | 334 | 880 |
| 116 | NC0002782 | 6 | 133.5 | 0.048355 | -0.01117 | A | Study 1 | CV076 | 121 | 881 |
| 116 | NC0053636 | 6 | 136 | 0.045675 | -0.00319 | G | Study 1 | -- | 202 | 882 |
| 116 | NC0053636 | 6 | 136 | 0.016849 | 0.01583 | A | Study 1 | CV011 | 202 | 882 |
| 116 | NC0053636 | 6 | 136 | 0.036309 | -0.05411 | C | Study 2 | -- | 202 | 882 |
| 116 | NC0009667 | 6 | 139.1 | 0.001978 | -0.09141 | C | Study 1 | CV153 | 226 | 883 |
| 116 | NC0009667 | 6 | 139.1 | 0.039128 | 0.01094 | G | Study 1 | CV108 | 226 | 883 |
| 116 | NC0009667 | 6 | 139.1 | 0.007861 | -0.01765 | G | Study 5 | -- | 226 | 883 |
| 117 | NC0194601 | 6 | 143.7 | -- | -- | A | Study 1 | CV042 | 788 | 884 |
| 117 | NC0032370 | 6 | 144.3 | 0.017205 | -0.0463 | G | Study 1 | CV074 | 929 | 885 |
| 117 | NC0032370 | 6 | 144.3 | 0.022296 | 0.051491 | G | Study 1 | CV074 | 929 | 885 |
| 117 | NC0032370 | 6 | 144.3 | 0.021767 | 0.016438 | C | Study 1 | CV041 | 929 | 885 |
| 117 | NC0037555 | 6 | 144.7 | 0.00173 | -0.11044 | C | Study 1 | CV022 | 390 | 886 |
| 117 | NC0037555 | 6 | 144.7 | 0.042437 | -0.04497 | T | Study 1 | -- | 390 | 886 |
| 117 | NC0021734 | 6 | 145.4 | -- | -- | T | Study 4 | -- | 438 | 887 |
| 117 | NC0021734 | 6 | 145.4 | 0.0401 | 0.013298 | T | Study 1 | -- | 438 | 887 |
| 117 | NC0021734 | 6 | 145.4 | 0.03217 | -0.17298 | G | Study 1 | CV069 | 438 | 887 |

CONT.

| QTL | Marker | Chr | pos | sig | effect | res allele | Mapping Study | Fav. Parent | SNP Position | SEQ ID |
|---|---|---|---|---|---|---|---|---|---|---|
| 117 | NC0021734 | 6 | 145.4 | 0.00114 | -0.08377 | G | Study 1 | CV011 | 438 | 887 |
| 117 | NC0027223 | 6 | 145.8 | 0.026946 | 0.012531 | C | Study 1 | CV150 | 464 | 888 |
| 117 | NC0027223 | 6 | 145.8 | 0.002304 | 0.15636 | T | Study 1 | CV093 | 464 | 888 |
| 117 | NC0027223 | 6 | 145.8 | 0.048882 | 0.027138 | T | Study 1 | CV112 | 464 | 888 |
| 117 | NC0027223 | 6 | 145.8 | 0.002526 | -0.02085 | T | Study 1 | CV108 | 464 | 888 |
| 117 | NC0199633 | 6 | 146 | -- | -- | G | Study 5 | -- | 293 | 889 |
| 118 | NC0147609 | 7 | 7.1 | 0.032775 | -0.07552 | A | Study 1 | CV041 | 57 | 890 |
| 118 | NC0173584 | 7 | 8.5 | -- | -- | G | Study 5 | -- | 1001 | 891 |
| 119 | NC0173759 | 7 | 11.2 | -- | -- | G | Study 5 | -- | 1001 | 892 |
| 120 | NC0143514 | 7 | 29 | -- | -- | G | Study 4 | -- | 595 | 893 |
| 120 | NC0143514 | 7 | 29 | 0.036853 | 0.087404 | G | Study 1 | CV166 | 595 | 893 |
| 120 | NC0143514 | 7 | 29 | 0.015031 | -0.06975 | G | Study 1 | I294213 | 595 | 893 |
| 120 | NC0143514 | 7 | 29 | 0.013204 | 0.285677 | A | Study 1 | CV124 | 595 | 893 |
| 120 | NC0143514 | 7 | 29 | 0.041477 | -0.03466 | G | Study 1 | CV010 | 595 | 893 |
| 121 | NC0058637 | 7 | 33.3 | 0.038307 | -0.08092 | G | Study 1 | CV041 | 106 | 894 |
| 121 | NC0058637 | 7 | 33.3 | 0.017688 | -0.00579 | G | Study 1 | CV056 | 106 | 894 |
| 122 | NC0011865 | 7 | 43.5 | 0.028047 | 0.022764 | G | Study 1 | I283669 | 382 | 895 |
| 122 | NC0011865 | 7 | 43.5 | 0.000108 | -0.04483 | G | Study 1 | CV010 | 382 | 895 |
| 122 | NC0011865 | 7 | 43.5 | 0.009614 | -0.0061 | A | Study 1 | CV010 | 382 | 895 |
| 122 | NC0011865 | 7 | 43.5 | 0.007335 | 0.005945 | G | Study 1 | CV109 | 382 | 895 |
| 122 | NC0027347 | 7 | 43.8 | 0.04517 | -- | G | Study 4 | -- | 128 | 896 |
| 122 | NC0027347 | 7 | 43.8 | 0.037436 | -0.01001 | G | Study 1 | CV053 | 128 | 896 |
| 122 | NC0027347 | 7 | 43.8 | 0.000615 | 0.182675 | G | Study 1 | CV149 | 128 | 896 |
| 122 | NC0027347 | 7 | 43.8 | 0.003224 | -0.11165 | A | Study 1 | CV075 | 128 | 896 |
| 122 | NC0027347 | 7 | 43.8 | 0.004797 | 0.11196 | G | Study 1 | CV079 | 128 | 896 |
| 122 | NC0003924 | 7 | 43.9 | -- | -- | G | Study 5 | -- | 412 | 897 |
| 122 | NC0003924 | 7 | 43.9 | 0.038352 | -0.0098 | G | Study 1 | CV053 | 412 | 897 |
| 122 | NC0003924 | 7 | 43.9 | 0.042761 | -0.0142 | G | Study 1 | CV060 | 412 | 897 |
| 122 | NC0003924 | 7 | 43.9 | 0.04264 | -0.0043 | C | Study 1 | CV103 | 412 | 897 |
| 122 | NC0003924 | 7 | 43.9 | 0.023825 | -0.01121 | C | Study 1 | CV110 | 412 | 897 |
| 122 | NC0107497 | 7 | 43.9 | 0.036812 | -0.0086 | G | Study 1 | CV105 | 206 | 898 |
| 122 | NC0107497 | 7 | 43.9 | 0.049261 | -0.05212 | G | Study 1 | CV050 | 206 | 898 |

CONT.

| QTL | Marker | Chr | pos | sig | effect | res allele | Mapping Study | Fav. Parent | SNP Position | SEQ ID |
|---|---|---|---|---|---|---|---|---|---|---|
| 122 | NC0107497 | 7 | 43.9 | 0.014936 | -0.07033 | C | Study 1 | I294213 | 206 | 898 |
| 122 | NC0107497 | 7 | 43.9 | 0.043823 | -0.00691 | C | Study 1 | I294213 | 206 | 898 |
| 123 | NC0084006 | 7 | 51.2 | 0.041474 | -0.11864 | C | Study 1 | CV025 | 45 | 899 |
| 123 | NC0034565 | 7 | 52.2 | -- | -- | **** | Study 4 | -- | 57 | 900 |
| 123 | NC0034565 | 7 | 52.2 | 0.034282 | 0.006756 | **** | Study 1 | CV109 | 57 | 900 |
| 123 | NC0108168 | 7 | 56 | 0.036799 | -0.0137 | C | Study 1 | CV060 | 420 | 901 |
| 123 | NC0199526 | 7 | 56 | -- | -- | T | Study 5 | -- | 468 | 902 |
| 123 | NC0066143 | 7 | 57.1 | 0.03853 | -0.07245 | G | Study 1 | CV101 | 135 | 903 |
| 123 | NC0066143 | 7 | 57.1 | 0.036295 | -0.0197 | A | Study 1 | I294213 | 135 | 903 |
| 123 | NC0066143 | 7 | 57.1 | 0.034711 | -0.01218 | A | Study 1 | I294213 | 135 | 903 |
| 123 | NC0042164 | 7 | 57.4 | 0.00455 | 0.261062 | A | Study 1 | CV161 | 320 | 904 |
| 123 | NC0173495 | 7 | 57.7 | -- | -- | T | Study 5 | -- | 540 | 905 |
| 123 | NC0008712 | 7 | 58.1 | 0.011044 | -0.01516 | C | Study 1 | I294213 | 418 | 906 |
| 123 | NC0002225 | 7 | 58.5 | 0.006848 | -0.01126 | T | Study 1 | CV105 | 121 | 907 |
| 123 | NC0002225 | 7 | 58.5 | 0.010978 | -0.02802 | C | Study 1 | CV120 | 121 | 907 |
| 123 | NC0002225 | 7 | 58.5 | 0.048248 | -0.00302 | T | Study 1 | CV100 | 121 | 907 |
| 123 | NC0002225 | 7 | 58.5 | 0.048248 | -0.00302 | T | Study 1 | CV100 | 121 | 907 |
| 123 | NC0056253 | 7 | 60.4 | 0.013738 | -0.01619 | T | Study 1 | CV108 | 94 | 908 |
| 124 | NC0146556 | 7 | 60.4 | <.0001 | 0.113634 | T | Study 3 | -- | 187 | 909 |
| 124 | NC0146556 | 7 | 60.4 | -- | -- | G | Study 5 | -- | 187 | 909 |
| 124 | NC0173560 | 7 | 60.4 | -- | -- | T | Study 5 | -- | 343 | 910 |
| 124 | NC0027428 | 7 | 60.8 | -- | -- | T | Study 4 | -- | 189 | 911 |
| 124 | NC0027428 | 7 | 60.8 | 0.017474 | 0.087543 | C | Study 1 | CV079 | 189 | 911 |
| 124 | NC0027428 | 7 | 60.8 | 0.003035 | 0.12043 | C | Study 1 | CV079 | 189 | 911 |
| 124 | NC0028094 | 7 | 61.9 | 0.0016 | -0.18408 | A | Study 3 | -- | 260 | 912 |
| 124 | NC0000558 | 7 | 62.2 | -- | -- | T | Study 5 | -- | 118 | 913 |
| 124 | NC0000558 | 7 | 62.2 | 0.00002 | 0.230882 | T | Study 1 | CV149 | 118 | 913 |
| 124 | NC0069202 | 7 | 62.5 | 0.0014 | 0.119316 | G | Study 3 | -- | 514 | 914 |
| 124 | NC0030511 | 7 | 62.8 | 0.041494 | -0.01482 | T | Study 1 | CV139 | 352 | 915 |
| 124 | NC0039064 | 7 | 62.8 | -- | -- | T | Study 4 | -- | 317 | 916 |
| 124 | NC0105086 | 7 | 62.8 | -- | -- | T | Study 4 | -- | 326 | 917 |
| 124 | NC0108360 | 7 | 62.8 | 0.042224 | -0.01489 | G | Study 1 | CV139 | 263 | 918 |
| 124 | NC0108360 | 7 | 62.8 | 0.027426 | -0.08092 | A | Study 1 | CV101 | 263 | 918 |

CONT.

| QTL | Marker | Chr | pos | sig | effect | res allele | Mapping Study | Fav. Parent | SNP Position | SEQ ID |
|---|---|---|---|---|---|---|---|---|---|---|
| 124 | NC0108360 | 7 | 62.8 | 0.016278 | -0.09296 | G | Study 1 | CV075 | 263 | 918 |
| 124 | NC0108360 | 7 | 62.8 | 0.008016 | -0.02483 | G | Study 1 | I294213 | 263 | 918 |
| 124 | NC0108360 | 7 | 62.8 | 0.000108 | 0.209144 | A | Study 1 | CV149 | 263 | 918 |
| 124 | NC0108360 | 7 | 62.8 | 0.040494 | -0.01207 | G | Study 1 | I294213 | 263 | 918 |
| 124 | NC0108360 | 7 | 62.8 | 0.023129 | -0.01333 | G | Study 1 | CV100 | 263 | 918 |
| 124 | NC0108360 | 7 | 62.8 | 0.008053 | 0.096373 | A | Study 1 | CV079 | 263 | 918 |
| 124 | NC0108360 | 7 | 62.8 | 0.004609 | 0.114413 | A | Study 1 | CV079 | 263 | 918 |
| 124 | NC0034215 | 7 | 63.1 | -- | -- | T | Study 4 | -- | 204 | 919 |
| 124 | NC0155984 | 7 | 63.1 | 0.013214 | -0.00427 | C | Study 1 | CV100 | 68 | 920 |
| 124 | NC0028277 | 7 | 63.4 | -- | -- | C | Study 5 | -- | 42 | 921 |
| 124 | NC0034121 | 7 | 64.1 | -- | -- | G | Study 4 | -- | 70 | 922 |
| 124 | NC0078294 | 7 | 64.2 | -- | -- | T | Study 4 | -- | 99 | 923 |
| 124 | NC0078294 | 7 | 64.2 | 0.025428 | -0.08337 | G | Study 1 | CV101 | 99 | 923 |
| 124 | NC0078294 | 7 | 64.2 | 0.028201 | -0.16627 | T | Study 1 | CV112 | 99 | 923 |
| 124 | NC0078294 | 7 | 64.2 | 0.03523 | 0.012348 | G | Study 1 | CV011 | 99 | 923 |
| 124 | NC0004299 | 7 | 64.4 | 0.00037 | 0.025051 | G | Study 1 | -- | 39 | 924 |
| 124 | NC0078783 | 7 | 64.4 | -- | -- | T | Study 4 | -- | 326 | 925 |
| 124 | NC0009073 | 7 | 65.9 | -- | -- | * | Study 4 | -- | 191 | 926 |
| 124 | NC0019507 | 7 | 65.9 | 0.0084 | -0.04456 | T | Study 1 | CV010 | 237 | 927 |
| 124 | NC0019507 | 7 | 65.9 | 0.017448 | -0.00547 | T | Study 1 | CV010 | 237 | 927 |
| 124 | NC0105767 | 7 | 65.9 | -- | -- | T | Study 5 | -- | 312 | 928 |
| 124 | NC0068424 | 7 | 66.2 | 0.003921 | -0.18207 | C | Study 1 | CV041 | 295 | 929 |
| 124 | NC0068426 | 7 | 66.5 | 0.007333 | 0.096674 | C | Study 1 | CV079 | 425 | 930 |
| 124 | NC0068426 | 7 | 66.5 | 0.002856 | 0.119341 | C | Study 1 | CV079 | 425 | 930 |
| 124 | NC0068426 | 7 | 66.5 | 0.029271 | -0.0103 | G | Study 1 | CV053 | 425 | 930 |
| 124 | NC0034688 | 7 | 69.4 | -- | -- | G | Study 4 | -- | 203 | 931 |
| 124 | NC0066422 | 7 | 69.4 | 0.003677 | 0.12019 | A | Study 1 | CV166 | 178 | 932 |
| 124 | NC0066422 | 7 | 69.4 | 0.003944 | -0.01258 | G | Study 1 | CV105 | 178 | 932 |
| 124 | NC0147598 | 7 | 70.1 | -- | -- | T | Study 1 | -- | 557 | 933 |
| 125 | NC0199886 | 7 | 71.1 | -- | -- | T | Study 5 | -- | 201 | 934 |
| 125 | NC0033620 | 7 | 75.7 | 0.028609 | -0.01026 | T | Study 1 | CV053 | 290 | 935 |
| 125 | NC0033620 | 7 | 75.7 | 0.004491 | 0.116704 | A | Study 1 | CV166 | 290 | 935 |
| 125 | NC0033620 | 7 | 75.7 | 0.045844 | 0.016977 | A | Study 1 | CV073 | 290 | 935 |

CONT.

| QTL | Marker | Chr | pos | sig | effect | res allele | Mapping Study | Fav. Parent | SNP Position | SEQ ID |
|---|---|---|---|---|---|---|---|---|---|---|
| 125 | NC0033620 | 7 | 75.7 | 0.001747 | 0.180311 | A | Study 1 | CV160 | 290 | 935 |
| 125 | NC0068434 | 7 | 76.5 | -- | -- | T | Study 5 | -- | 573 | 936 |
| 125 | NC0068434 | 7 | 76.5 | 0.000099 | 0.025696 | C | Study 1 | -- | 573 | 936 |
| 125 | NC0068434 | 7 | 76.5 | 0.003839 | -0.18408 | T | Study 1 | CV041 | 573 | 936 |
| 125 | NC0068434 | 7 | 76.5 | 0.018076 | 0.008093 | T | Study 1 | CV091 | 573 | 936 |
| 125 | NC0033509 | 7 | 77.2 | -- | -- | T | Study 5 | -- | 154 | 937 |
| 125 | NC0029362 | 7 | 78.4 | 0.036242 | -0.01619 | C | Study 1 | CV041 | 95 | 938 |
| 125 | NC0029362 | 7 | 78.4 | 0.00436 | -0.01199 | C | Study 1 | CV110 | 95 | 938 |
| 125 | NC0037827 | 7 | 78.4 | -- | -- | T | Study 5 | -- | 332 | 939 |
| 126 | NC0145922 | 7 | 80.5 | -- | -- | G | Study 5 | -- | 451 | 940 |
| 126 | NC0145922 | 7 | 80.5 | 0.003196 | -0.04928 | A | Study 1 | CV010 | 451 | 940 |
| 126 | NC0145922 | 7 | 80.5 | 0.019316 | -0.00533 | A | Study 1 | CV010 | 451 | 940 |
| 126 | NC0057013 | 7 | 80.7 | -- | -- | G | Study 4 | -- | 220 | 941 |
| 126 | NC0057013 | 7 | 80.7 | 0.005695 | -0.20652 | A | Study 1 | CV112 | 220 | 941 |
| 126 | NC0057013 | 7 | 80.7 | 0.003597 | -0.02708 | A | Study 1 | I294213 | 220 | 941 |
| 126 | NC0057013 | 7 | 80.7 | 0.033104 | 0.054915 | A | Study 1 | CV112 | 220 | 941 |
| 126 | NC0057013 | 7 | 80.7 | 0.006049 | 0.015585 | G | Study 1 | CV011 | 220 | 941 |
| 126 | NC0048425 | 7 | 88.3 | -- | -- | T | Study 4 | -- | 484 | 942 |
| 126 | NC0048425 | 7 | 88.3 | 0.002103 | -0.05214 | T | Study 1 | CV010 | 484 | 942 |
| 126 | NC0048425 | 7 | 88.3 | 0.018549 | -0.00545 | T | Study 1 | CV010 | 484 | 942 |
| 126 | NC0048425 | 7 | 88.3 | 0.045991 | 0.088032 | C | Study 1 | CV148 | 484 | 942 |
| 126 | NC0048425 | 7 | 88.3 | 0.003862 | -0.0127 | T | Study 1 | CV110 | 484 | 942 |
| 126 | NC0035408 | 7 | 89.5 | 0.036009 | -0.000922 | C | Study 1 | CV105 | 221 | 943 |
| 126 | NC0035408 | 7 | 89.5 | 0.044378 | -0.009 | C | Study 1 | I294213 | 221 | 943 |
| 126 | NC0035408 | 7 | 89.5 | 0.017602 | -0.10008 | C | Study 1 | CV067 | 221 | 943 |
| 126 | NC0035408 | 7 | 89.5 | 0.027149 | 0.005198 | C | Study 1 | CV051 | 221 | 943 |
| 126 | NC0035408 | 7 | 89.5 | 0.013264 | -0.01707 | A | Study 1 | CV072 | 221 | 943 |
| 126 | NC0035408 | 7 | 89.5 | 0.014968 | -0.01438 | C | Study 1 | I294213 | 221 | 943 |
| 127 | NC0005051 | 7 | 91.3 | -- | -- | T | Study 5 | -- | 98 | 944 |
| 127 | NC0005051 | 7 | 91.3 | 0.041309 | -0.09649 | C | Study 1 | CV069 | 98 | 944 |
| 127 | NC0005051 | 7 | 91.3 | 0.010046 | -0.19408 | T | Study 1 | CV112 | 98 | 944 |
| 127 | NC0005051 | 7 | 91.3 | 0.01526 | 0.062791 | T | Study 1 | CV112 | 98 | 944 |
| 127 | NC0043388 | 7 | 91.3 | 0.032728 | -0.08291 | G | Study 1 | CV075 | 643 | 945 |

CONT.

| QTL | Marker | Chr | pos | sig | effect | res allele | Mapping Study | Fav. Parent | SNP Position | SEQ ID |
|---|---|---|---|---|---|---|---|---|---|---|
| 127 | NC0199752 | 7 | 92.9 | -- | -- | -- | Study 5 | -- | 210 | 946 |
| 127 | NC0020649 | 7 | 93.6 | 0.045919 | -0.01543 | T | Study 1 | CV041 | 301 | 947 |
| 127 | NC0020649 | 7 | 93.6 | 0.005444 | -0.00807 | T | Study 1 | CV052 | 301 | 947 |
| 127 | NC0020649 | 7 | 93.6 | 0.021003 | -0.02187 | T | Study 1 | I294213 | 301 | 947 |
| 127 | NC0020649 | 7 | 93.6 | 0.026009 | 0.080346 | T | Study 1 | CV079 | 301 | 947 |
| 127 | NC0020649 | 7 | 93.6 | 0.012795 | 0.099773 | T | Study 1 | CV079 | 301 | 947 |
| 127 | NC0038914 | 7 | 96.6 | 0.000163 | 0.025088 | **** | Study 1 | -- | 129 | 948 |
| 127 | NC0038914 | 7 | 96.6 | 0.006651 | -0.00767 | ATTA | Study 1 | CV052 | 129 | 948 |
| 127 | NC0038914 | 7 | 96.6 | 0.001876 | 0.165881 | ATTA | Study 1 | CV149 | 129 | 948 |
| 127 | NC0009240 | 7 | 98.5 | 0.049176 | -0.03338 | A | Study 1 | CV010 | 379 | 949 |
| 127 | NC0009240 | 7 | 98.5 | 0.035094 | 0.016043 | A | Study 1 | CV169 | 379 | 949 |
| 127 | NC0155829 | 7 | 99 | -- | -- | -- | Study 5 | -- | 416 | 950 |
| 127 | NC0155829 | 7 | 99 | 0.021592 | -0.09031 | G | Study 1 | CV075 | 416 | 950 |
| 127 | NC0155829 | 7 | 99 | 0.008108 | 0.10967 | G | Study 1 | CV166 | 416 | 950 |
| 127 | NC0155829 | 7 | 99 | 0.001779 | 0.114483 | A | Study 1 | CV079 | 416 | 950 |
| 127 | NC0155829 | 7 | 99 | 0.007151 | 0.109911 | A | Study 1 | CV079 | 416 | 950 |
| 127 | NC0071001 | 7 | 99.4 | 0.044212 | 0.004539 | C | Study 1 | CV051 | 359 | 951 |
| 127 | NC0034583 | 7 | 99.5 | 0.021863 | 0.05913 | T | Study 1 | CV112 | 74 | 952 |
| 127 | NC0070402 | 7 | 99.8 | -- | -- | -- | Study 5 | -- | 322 | 953 |
| 128 | NC0031157 | 7 | 100 | -- | -- | -- | Study 5 | -- | 458 | 954 |
| 128 | NC0173580 | 7 | 100 | -- | -- | -- | Study 5 | -- | 919 | 955 |
| 128 | NC0015995 | 7 | 104.6 | 0.007 | -0.00766 | C | Study 1 | CV052 | 438 | 956 |
| 128 | NC0015995 | 7 | 104.6 | 0.014316 | 0.005256 | C | Study 1 | CV051 | 438 | 956 |
| 128 | NC0016008 | 7 | 104.6 | 0.008973 | 0.014024 | C | Study 1 | -- | 133 | 957 |
| 128 | NC0199892 | 7 | 104.6 | -- | -- | -- | Study 5 | -- | 94 | 958 |
| 128 | NC0145260 | 7 | 104.9 | 0.000518 | 0.148069 | C | Study 1 | CV166 | 149 | 959 |
| 128 | NC0018284 | 7 | 105.8 | 0.008549 | -0.06565 | C | Study 1 | CV022 | 243 | 960 |
| 128 | NC0039773 | 7 | 106.1 | 0.016541 | -0.01643 | T | Study 1 | CV072 | 42 | 961 |
| 128 | NC0039773 | 7 | 106.1 | 0.005159 | 0.014812 | C | Study 1 | -- | 42 | 961 |
| 128 | NC0015161 | 7 | 106.4 | -- | -- | G | Study 5 | -- | 428 | 962 |
| 128 | NC0015161 | 7 | 106.4 | 0.047566 | 0.083705 | G | Study 1 | CV125 | 428 | 962 |
| 128 | NC0040335 | 7 | 107 | <.0001 | -0.15411 | A | Study 3 | -- | 407 | 963 |
| 128 | NC0040335 | 7 | 107 | 0.016304 | -0.00818 | G | Study 1 | CV122 | 407 | 963 |

CONT.

| QTL | Marker | Chr | pos | sig | effect | res allele | Mapping Study | Fav. Parent | SNP Position | SEQ ID |
|---|---|---|---|---|---|---|---|---|---|---|
| 128 | NC0040335 | 7 | 107 | 0.001759 | 0.114507 | G | Study 1 | CV079 | 407 | 963 |
| 128 | NC0040335 | 7 | 107 | 0.014784 | 0.099806 | G | Study 1 | CV079 | 407 | 963 |
| 129 | NC0009674 | 7 | 112.1 | 0.00097 | 0.019861 | G | Study 1 | -- | 150 | 964 |
| 129 | NC0009674 | 7 | 112.1 | 0.01699 | 0.005264 | G | Study 1 | CV051 | 150 | 964 |
| 129 | NC0009674 | 7 | 112.1 | 0.022759 | 0.122281 | G | Study 1 | CV149 | 150 | 964 |
| 129 | NC0030029 | 7 | 112.7 | 0.024426 | 0.09597 | C | Study 1 | CV125 | 315 | 965 |
| 129 | NC0018565 | 7 | 115.2 | 0.00945 | -0.05962 | CGA | Study 1 | CV022 | 164 | 966 |
| 129 | NC0018565 | 7 | 115.2 | 0.023197 | -0.08759 | CGA | Study 1 | CV075 | 164 | 966 |
| 129 | NC0018565 | 7 | 115.2 | 0.020514 | 0.006782 | CGA | Study 1 | CV128 | 164 | 966 |
| 129 | NC0018565 | 7 | 115.2 | 0.049091 | -0.07093 | CGA | Study 1 | I294213 | 164 | 966 |
| 129 | NC0027069 | 7 | 116.1 | -- | -- | T | Study 4 | -- | 339 | 967 |
| 129 | NC0027069 | 7 | 116.1 | 0.015062 | 0.103812 | T | Study 1 | CV166 | 339 | 967 |
| 129 | NC0027069 | 7 | 116.1 | 0.000046 | 0.144657 | T | Study 1 | CV079 | 339 | 967 |
| 129 | NC0027069 | 7 | 116.1 | 0.001417 | 0.127179 | T | Study 1 | CV079 | 339 | 967 |
| 129 | NC0003218 | 7 | 117.9 | 0.006576 | 0.018163 | C | Study 1 | -- | 342 | 968 |
| 129 | NC0003218 | 7 | 117.9 | 0.00497 | -0.00792 | T | Study 1 | CV052 | 342 | 968 |
| 129 | NC0003218 | 7 | 117.9 | 0.048349 | -0.09639 | C | Study 1 | CV068 | 342 | 968 |
| 129 | NC0003218 | 7 | 117.9 | 0.022904 | 0.016111 | T | Study 1 | CV074 | 342 | 968 |
| 129 | NC0003218 | 7 | 117.9 | 0.029603 | 0.005658 | C | Study 1 | CV024 | 342 | 968 |
| 130 | NC0021967 | 7 | 122.7 | -- | -- | C | Study 5 | -- | 406 | 969 |
| 130 | NC0108979 | 7 | 124.7 | -- | -- | G | Study 5 | -- | 232 | 970 |
| 130 | NC0148208 | 7 | 126.9 | 0.02897 | 0.011683 | C | Study 1 | -- | 216 | 971 |
| 130 | NC0112796 | 7 | 130.1 | 0.03255 | 0.015227 | C | Study 1 | CV074 | 145 | 972 |
| 131 | NC0173357 | 7 | 131 | -- | -- | T | Study 5 | -- | 106 | 973 |
| 131 | NC0004953 | 7 | 131.2 | -- | -- | T | Study 4 | -- | 154 | 974 |
| 131 | NC0004953 | 7 | 131.2 | 0.038002 | -0.16879 | T | Study 1 | I294213 | 154 | 974 |
| 131 | NC0004953 | 7 | 131.2 | 0.020682 | 0.270301 | A | Study 1 | CV124 | 154 | 974 |
| 131 | NC0004953 | 7 | 131.2 | 0.004498 | -0.0199 | A | Study 1 | CV072 | 154 | 974 |
| 131 | NC0004953 | 7 | 131.2 | 0.017215 | 0.137667 | T | Study 1 | CV160 | 154 | 974 |
| 131 | NC0004953 | 7 | 131.2 | 0.003137 | 0.10733 | T | Study 1 | CV079 | 154 | 974 |
| 131 | NC0004953 | 7 | 131.2 | 0.005862 | 0.111135 | T | Study 1 | CV079 | 154 | 974 |
| 131 | NC0015974 | 7 | 135.9 | 0.016924 | 0.012659 | G | Study 1 | -- | 523 | 975 |
| 131 | NC0015974 | 7 | 135.9 | 0.033889 | 0.022775 | G | Study 1 | CV134 | 523 | 975 |

CONT.

| QTL | Marker | Chr | pos | sig | effect | res allele | Mapping Study | Fav. Parent | SNP Position | SEQ ID |
|---|---|---|---|---|---|---|---|---|---|---|
| 131 | NC0015974 | 7 | 135.9 | 0.048657 | -0.00261 | G | Study 1 | CV100 | 523 | 975 |
| 131 | NC0015974 | 7 | 135.9 | 0.048657 | -0.00261 | G | Study 1 | CV100 | 523 | 975 |
| 131 | NC0110771 | 7 | 138.5 | -- | -- | C | Study 4 | -- | 490 | 976 |
| 131 | NC0110771 | 7 | 138.5 | 0.046346 | -0.00644 | A | Study 1 | CV122 | 490 | 976 |
| 131 | NC0110771 | 7 | 138.5 | 0.003219 | -0.07164 | A | Study 1 | CV022 | 490 | 976 |
| 131 | NC0110771 | 7 | 138.5 | 0.035734 | 0.130732 | A | Study 1 | CV073 | 490 | 976 |
| 131 | NC0110771 | 7 | 138.5 | 0.019402 | 0.006575 | A | Study 1 | CV024 | 490 | 976 |
| 132 | NC0199352 | 7 | 147.2 | -- | -- | T | Study 5 | -- | 327 | 977 |
| 133 | NC0199339 | 7 | 150.8 | -- | -- | C | Study 5 | -- | 214 | 978 |
| 133 | NC0011664 | 7 | 150.9 | -- | -- | T | Study 5 | -- | 84 | 979 |
| 133 | NC0011664 | 7 | 150.9 | 0.023166 | -0.05374 | T | Study 1 | CV022 | 84 | 979 |
| 133 | NC0146593 | 7 | 152.9 | 0.004845 | 0.317776 | C | Study 1 | CV124 | 122 | 980 |
| 133 | NC0146593 | 7 | 152.9 | 0.010074 | -0.15074 | C | Study 1 | I294213 | 122 | 980 |
| 133 | NC0146593 | 7 | 152.9 | 0.037992 | 0.074353 | C | Study 1 | CV079 | 122 | 980 |
| 133 | NC0146593 | 7 | 152.9 | 0.025479 | 0.088883 | C | Study 1 | CV079 | 122 | 980 |
| 133 | NC0155475 | 7 | 154.2 | 0.040658 | 0.059887 | T | Study 1 | CV150 | 77 | 981 |
| 133 | NC0155475 | 7 | 154.2 | 0.036707 | 0.068893 | T | Study 1 | CV150 | 77 | 981 |
| 133 | NC0143371 | 7 | 156.6 | 0.016396 | -0.00461 | G | Study 1 | CV010 | 80 | 982 |
| 133 | NC0143371 | 7 | 156.6 | 0.031174 | -0.04201 | T | Study 1 | CV042 | 80 | 982 |
| 133 | NC0143371 | 7 | 156.6 | 0.020148 | -0.00725 | T | Study 1 | CV052 | 80 | 982 |
| 134 | NC0151568 | 7 | 161.1 | 0.023028 | 0.009803 | C | Study 1 | CV170 | 515 | 983 |
| 134 | NC0151568 | 7 | 161.1 | 0.006961 | -0.00508 | T | Study 1 | CV010 | 515 | 983 |
| 134 | NC0151568 | 7 | 161.1 | 0.019075 | -0.0159 | T | Study 1 | CV072 | 515 | 983 |
| 134 | NC0151568 | 7 | 161.1 | 0.018193 | -0.12163 | C | Study 1 | CV112 | 515 | 983 |
| 134 | NC0078091 | 7 | 164.6 | 0.018514 | -0.04508 | G | Study 1 | CV042 | 194 | 984 |
| 134 | NC0078091 | 7 | 164.6 | 0.03312 | -0.00665 | G | Study 1 | CV052 | 194 | 984 |
| 134 | NC0078091 | 7 | 164.6 | 0.016483 | 0.009193 | A | Study 1 | CV101 | 194 | 984 |
| 134 | NC0078091 | 7 | 164.6 | 0.035248 | 0.131718 | A | Study 1 | CV073 | 194 | 984 |
| 134 | NC0078091 | 7 | 164.6 | 0.04593 | 0.004625 | A | Study 1 | CV102 | 194 | 984 |
| 134 | NC0078091 | 7 | 164.6 | 0.033482 | 0.069721 | G | Study 1 | CV150 | 194 | 984 |
| 134 | NC0146620 | 7 | 165.7 | 0.03892 | -0.0039 | T | Study 1 | CV010 | 306 | 985 |
| 134 | NC0146620 | 7 | 165.7 | 0.016279 | 0.012687 | C | Study 1 | -- | 306 | 985 |
| 134 | NC0038317 | 7 | 165.8 | -- | -- | T | Study 4 | -- | 207 | 986 |

CONT.

| QTL | Marker | Chr | pos | sig | effect | res allele | Mapping Study | Fav. Parent | SNP Position | SEQ ID |
|---|---|---|---|---|---|---|---|---|---|---|
| 134 | NC0036490 | 7 | 166.9 | -- | -- | T | Study 4 | -- | 244 | 987 |
| 134 | NC0028596 | 7 | 168.9 | 0.046576 | 0.15859 | T | Study 1 | CV073 | 121 | 988 |
| 134 | NC0036559 | 7 | 169.2 | -- | -- | G | Study 5 | -- | 269 | 989 |
| 134 | NC0038499 | 7 | 169.3 | -- | -- | G | Study 4 | -- | 597 | 990 |
| 134 | NC0106258 | 7 | 170.9 | -- | -- | G | Study 4 | -- | 349 | 991 |
| 135 | NC0106258 | 7 | 170.9 | 0.004542 | -0.01835 | C | Study 1 | CV047 | 349 | 991 |
| 135 | NC0106258 | 7 | 170.9 | 0.012527 | 0.279708 | C | Study 1 | CV124 | 349 | 991 |
| 135 | NC0021038 | 7 | 171.4 | -- | -- | T | Study 4 | -- | 126 | 992 |
| 135 | NC0021038 | 7 | 171.4 | -- | -- | T | Study 5 | -- | 126 | 992 |
| 135 | NC0021038 | 7 | 171.4 | 0.00324 | 0.011073 | A | Study 1 | CV101 | 126 | 992 |
| 135 | NC0021038 | 7 | 171.4 | 0.01175 | 0.138137 | A | Study 1 | CV164 | 126 | 992 |
| 135 | NC0021038 | 7 | 171.4 | 0.005401 | -0.01882 | A | Study 1 | CV072 | 126 | 992 |
| 135 | NC0021038 | 7 | 171.4 | 0.009433 | 0.021273 | A | Study 1 | -- | 126 | 992 |
| 135 | NC0021045 | 7 | 171.4 | -- | -- | T | Study 5 | -- | 308 | 993 |
| 135 | NC0018157 | 7 | 171.7 | -- | -- | T | Study 4 | -- | 577 | 994 |
| 135 | NC0071624 | 7 | 171.7 | 0.04423 | -0.03853 | G | Study 1 | CV042 | 101 | 995 |
| 135 | NC0019704 | 7 | 173.9 | 0.028024 | 0.009225 | A | Study 1 | CV170 | 183 | 996 |
| 135 | NC0019704 | 7 | 173.9 | 0.048012 | 0.085483 | T | Study 1 | CV166 | 183 | 996 |
| 135 | NC0019704 | 7 | 173.9 | 0.017618 | 0.267911 | T | Study 1 | CV124 | 183 | 996 |
| 136 | NC0024672 | 8 | 33.6 | 0.020532 | -0.05842 | A | Study 1 | CV022 | 134 | 997 |
| 136 | NC0024672 | 8 | 33.6 | 0.010188 | -0.00768 | A | Study 1 | CV138 | 134 | 997 |
| 136 | NC0032600 | 8 | 37.8 | -- | -- | T | Study 5 | -- | 208 | 998 |
| 136 | NC0019198 | 8 | 38.1 | 0.024171 | 0.016668 | T | Study 1 | CV065 | 316 | 999 |
| 136 | NC0019198 | 8 | 38.1 | 0.048339 | -0.05621 | T | Study 1 | I294213 | 316 | 999 |
| 136 | NC0038724 | 8 | 39.6 | 0.000131 | 0.11118 | A | Study 2 | -- | 312 | 1000 |
| 136 | NC0038724 | 8 | 39.6 | -- | -- | C | Study 4 | -- | 312 | 1000 |
| 136 | NC0038724 | 8 | 39.6 | 0.006446 | -0.19023 | C | Study 1 | CV069 | 312 | 1000 |
| 136 | NC0038724 | 8 | 39.6 | 0.039369 | -0.05052 | A | Study 1 | CV022 | 312 | 1000 |
| 136 | NC0038724 | 8 | 39.6 | 0.002728 | -0.01365 | A | Study 1 | CV087 | 312 | 1000 |
| 136 | NC0038724 | 8 | 39.6 | 0.04899 | 0.011796 | A | Study 1 | CV013 | 312 | 1000 |
| 136 | NC0038724 | 8 | 39.6 | 0.000006 | -0.24759 | A | Study 1 | -- | 312 | 1000 |
| 137 | NC0040299 | 8 | 41.2 | -- | -- | T | Study 5 | -- | 105 | 1001 |
| 137 | NC0040299 | 8 | 41.2 | 0.044562 | -0.15915 | T | Study 1 | I294213 | 105 | 1001 |

CONT.

| QTL | Marker | Chr | pos | sig | effect | res allele | Mapping Study | Fav. Parent | SNP Position | SEQ ID |
|---|---|---|---|---|---|---|---|---|---|---|
| 137 | NC0040299 | 8 | 41.2 | 0.049265 | -0.13762 | T | Study 1 | I294213 | 105 | 1001 |
| 137 | NC0040299 | 8 | 41.2 | 0.039212 | 0.181986 | T | Study 1 | CV130 | 105 | 1001 |
| 137 | NC0003792 | 8 | 41.7 | 0.010233 | 0.00618 | T | Study 1 |  | 110 | 1002 |
| 137 | NC0003792 | 8 | 41.7 | 0.045603 | -0.00526 | C | Study 1 | CV088 | 110 | 1002 |
| 137 | NC0003792 | 8 | 41.7 | 0.000778 | -0.26121 | C | Study 1 | CV044 | 110 | 1002 |
| 137 | NC0003792 | 8 | 41.7 | 0 | 0.178083 | C | Study 1 | CV079 | 110 | 1002 |
| 137 | NC0003792 | 8 | 41.7 | 0.000001 | 0.18984 | C | Study 1 | CV079 | 110 | 1002 |
| 137 | NC0199597 | 8 | 42.5 |  |  | G | Study 5 |  | 700 | 1003 |
| 138 | NC0029842 | 8 | 51.6 | 0.032047 | 0.036264 | G | Study 1 | CV114 | 261 | 1004 |
| 138 | NC0029842 | 8 | 51.6 | 0.003155 | -0.00834 | A | Study 1 | CV138 | 261 | 1004 |
| 138 | NC0029842 | 8 | 51.6 | 0.021261 | 0.211863 | A | Study 1 | CV130 | 261 | 1004 |
| 138 | NC0029842 | 8 | 51.6 | 0.007907 | -0.07667 | A | Study 1 | CV106 | 261 | 1004 |
| 138 | NC0008934 | 8 | 51.8 | 0.004712 | -0.08007 | T | Study 1 | I294213 | 140 | 1005 |
| 138 | NC0034552 | 8 | 51.8 | 0.043494 | -0.00844 | C | Study 1 | CV088 | 258 | 1006 |
| 138 | NC0034552 | 8 | 51.8 | 0.008952 | -0.00704 | C | Study 1 | CV088 | 258 | 1006 |
| 138 | NC0034552 | 8 | 51.8 | 0.013027 | 0.061094 | T | Study 1 | CV135 | 258 | 1006 |
| 138 | NC0034552 | 8 | 51.8 | 0.019355 | 0.022981 | T | Study 1 | CV135 | 258 | 1006 |
| 138 | NC0034552 | 8 | 51.8 | 0.048801 | 0.146979 | C | Study 1 | CV163 | 258 | 1006 |
| 138 | NC0034552 | 8 | 51.8 | 0.000122 | 0.02322 | T | Study 1 | CV079 | 258 | 1006 |
| 138 | NC0034552 | 8 | 51.8 | 0.014927 | -0.19185 | G | Study 1 | I294213 | 258 | 1006 |
| 138 | NC0034552 | 8 | 51.8 | 0.026279 | -0.16112 | C | Study 1 | I294213 | 258 | 1006 |
| 138 | NC0034552 | 8 | 51.8 | 0.000007 | 0.157786 | T | Study 1 | CV079 | 258 | 1006 |
| 138 | NC0034552 | 8 | 51.8 | 0.000506 | 0.137859 | C | Study 1 | CV079 | 258 | 1006 |
| 138 | NC0105809 | 8 | 53.4 | 0.042872 | 0.009719 | C | Study 1 | CV100 | 258 | 1007 |
| 138 | NC0005266 | 8 | 56.5 | 1.83E-07 | 0.148108 | T | Study 2 |  | 56 | 1008 |
| 138 | NC0005266 | 8 | 56.5 | 0.011829 | 0.01852 | C | Study 1 | CV065 | 214 | 1008 |
| 138 | NC0005266 | 8 | 56.5 | 0.047479 | 0.007997 | C | Study 1 |  | 214 | 1008 |
| 138 | NC0005266 | 8 | 56.5 | 0.006321 | 0.028785 | T | Study 1 | CV134 | 214 | 1008 |
| 138 | NC0005266 | 8 | 56.5 | 0.000284 | -0.02115 | C | Study 1 | CV025 | 214 | 1008 |
| 138 | NC0005266 | 8 | 56.5 | 0.018161 | -0.01917 | T | Study 1 | CV057 | 214 | 1008 |
| 138 | NC0005266 | 8 | 56.5 | 0 | -0.29464 | C | Study 1 |  | 214 | 1008 |
| 138 | NC0058392 | 8 | 56.6 | 0.042078 | -0.00535 | T | Study 1 | CV088 | 291 | 1009 |
| 138 | NC0058392 | 8 | 56.6 | 0.018186 | 0.073146 | C | Study 1 | CV114 | 291 | 1009 |

CONT.

| QTL | Marker | Chr | pos | sig | effect | res allele | Mapping Study | Fav. Parent | SNP Position | SEQ ID |
|---|---|---|---|---|---|---|---|---|---|---|
| 138 | NC0058392 | 8 | 56.6 | 0.000283 | -0.09407 | C | Study 1 | CV057 | 291 | 1009 |
| 138 | NC0058392 | 8 | 56.6 | 0.038969 | 0.010819 | T | Study 1 | CV153 | 291 | 1009 |
| 138 | NC0111628 | 8 | 57.3 | 0.003659 | 0.017693 | A | Study 1 | CV013 | 140 | 1010 |
| 139 | NC0037392 | 8 | 60 | <.0001 | -0.13471 | C | Study 3 | -- | 153 | 1011 |
| 139 | NC0037392 | 8 | 60 | 0.004449 | -0.01945 | T | Study 1 | CV113 | 153 | 1011 |
| 139 | NC0027485 | 8 | 60.1 | 0.017124 | -0.01359 | T | Study 1 | CV087 | 513 | 1012 |
| 139 | NC0030011 | 8 | 63.1 | -- | -- | G | Study 5 | -- | 326 | 1013 |
| 139 | NC0053899 | 8 | 65.9 | 0.021296 | 0.209606 | * | Study 1 | CV130 | 473 | 1014 |
| 139 | NC0010347 | 8 | 69.2 | 2.64E-06 | 0.13431 | A | Study 2 | -- | 160 | 1015 |
| 139 | NC0010347 | 8 | 69.2 | 0.027925 | 0.095621 | A | Study 1 | CV166 | 160 | 1015 |
| 140 | NC0104862 | 8 | 70 | 0.0001 | -0.23975 | C | Study 3 | -- | 321 | 1016 |
| 140 | NC0104862 | 8 | 70 | 0.006107 | -0.17656 | T | Study 1 | CV041 | 321 | 1016 |
| 140 | NC0104862 | 8 | 70 | 0.003291 | 0.158991 | C | Study 1 | CV164 | 321 | 1016 |
| 140 | NC0029015 | 8 | 71.1 | 5.15E-07 | 0.146253 | A | Study 2 | -- | 189 | 1017 |
| 140 | NC0029015 | 8 | 71.1 | -- | -- | G | Study 5 | -- | 189 | 1017 |
| 140 | NC0029015 | 8 | 71.1 | 0.019315 | -0.06329 | G | Study 1 | CV082 | 189 | 1017 |
| 140 | NC0029015 | 8 | 71.1 | 0.009176 | 0.011059 | G | Study 1 | -- | 189 | 1017 |
| 140 | NC0029015 | 8 | 71.1 | 0.000023 | -0.11853 | G | Study 1 | I294213 | 189 | 1017 |
| 140 | NC0029015 | 8 | 71.1 | 0.000429 | -0.0891 | G | Study 1 | CV057 | 189 | 1017 |
| 140 | NC0107396 | 8 | 71.1 | 0.02326 | -0.01819 | G | Study 1 | CV079 | 75 | 1018 |
| 140 | NC0107396 | 8 | 71.1 | 0.010357 | 0.016003 | * | Study 1 | -- | 75 | 1018 |
| 140 | NC0107396 | 8 | 71.1 | 0 | -0.3255 | * | Study 1 | CV079 | 75 | 1018 |
| 140 | NC0107396 | 8 | 71.1 | 0.02425 | 0.080622 | * | Study 1 | CV145 | 75 | 1018 |
| 140 | NC0107396 | 8 | 71.1 | 0.017037 | 0.010681 | * | Study 1 | CV113 | 75 | 1018 |
| 140 | NC0107396 | 8 | 71.1 | 0.000332 | -0.02505 | T | Study 1 | CV007 | 75 | 1018 |
| 140 | NC0107396 | 8 | 71.1 | 0.031156 | 0.010586 | T | Study 1 | -- | 75 | 1018 |
| 140 | NC0022765 | 8 | 72.4 | -- | -- | T | Study 5 | -- | 501 | 1019 |
| 140 | NC0009659 | 8 | 72.9 | 0.005213 | 0.113132 | T | Study 1 | CV114 | 410 | 1020 |
| 140 | NC0009659 | 8 | 72.9 | 0.018128 | 0.026174 | A | Study 1 | CV134 | 410 | 1020 |
| 140 | NC0009659 | 8 | 72.9 | 0.009958 | -0.00654 | T | Study 1 | CV138 | 410 | 1020 |
| 140 | NC0082612 | 8 | 78.9 | <.0001 | 0.128804 | G | Study 3 | -- | 309 | 1021 |
| 140 | NC0082612 | 8 | 78.9 | 0.014246 | -0.01 | G | Study 1 | I294213 | 309 | 1021 |
| 140 | NC0082612 | 8 | 78.9 | 0.011749 | 0.016148 | G | Study 1 | CV013 | 309 | 1021 |

CONT.

| QTL | Marker | Chr | pos | sig | effect | res allele | Mapping Study | Fav. Parent | SNP Position | SEQ ID |
|---|---|---|---|---|---|---|---|---|---|---|
| 140 | NC0082612 | 8 | 78.9 | 0.042229 | 0.186583 | G | Study 1 | CV130 | 309 | 1021 |
| 140 | NC0082612 | 8 | 78.9 | 0.032289 | -0.06256 | G | Study 1 | CV119 | 309 | 1021 |
| 140 | NC0082612 | 8 | 78.9 | 0.035547 | -0.06929 | G | Study 1 | CV119 | 309 | 1021 |
| 140 | NC0027361 | 8 | 79.6 | 0.000054 | -0.02319 | C | Study 1 | CV025 | 229 | 1022 |
| 141 | NC0011760 | 8 | 80.3 | 0.008733 | 0.019354 | C | Study 1 | CV065 | 56 | 1023 |
| 141 | NC0011760 | 8 | 80.3 | 0.004385 | -0.01504 | C | Study 1 | CV086 | 56 | 1023 |
| 141 | NC0011760 | 8 | 80.3 | 0.000648 | -0.08638 | G | Study 1 | CV057 | 56 | 1023 |
| 141 | NC0009254 | 8 | 83.9 | 0.004017 | -0.11596 | A | Study 1 | CV114 | 146 | 1024 |
| 141 | NC0009254 | 8 | 83.9 | 0.045929 | -0.01608 | A | Study 1 | CV057 | 146 | 1024 |
| 141 | NC0013946 | 8 | 84 | 0.0002 | -0.11743 | A | Study 3 | -- | 59 | 1025 |
| 141 | NC0015146 | 8 | 84 | 6.2E-07 | 0.142555 | A | Study 2 | -- | 426 | 1026 |
| 141 | NC0015146 | 8 | 84 | 0.030707 | 0.066995 | G | Study 1 | CV114 | 426 | 1026 |
| 141 | NC0015146 | 8 | 84 | 0.01298 | -0.00404 | C | Study 1 | CV010 | 426 | 1026 |
| 141 | NC0015146 | 8 | 84 | 0.01298 | -0.00404 | C | Study 1 | CV010 | 426 | 1026 |
| 141 | NC0077568 | 8 | 84 | 0.000005 | -0.25706 | G | Study 1 | -- | 245 | 1027 |
| 141 | NC0147465 | 8 | 84 | 0.004741 | -0.05869 | C | Study 1 | CV042 | 288 | 1028 |
| 141 | NC0147465 | 8 | 84 | 0.01496 | -0.08248 | C | Study 1 | CV017 | 288 | 1028 |
| 141 | NC0200189 | 8 | 86.9 | -- | -- | T | Study 5 | -- | 133 | 1029 |
| 141 | NC0022382 | 8 | 87.8 | -- | -- | G | Study 5 | -- | 134 | 1030 |
| 141 | NC0155968 | 8 | 87.9 | 0.00696 | 0.011743 | C | Study 1 | CV070 | 291 | 1031 |
| 141 | NC0155968 | 8 | 87.9 | 0.043 | -0.03588 | T | Study 1 | CV166 | 291 | 1031 |
| 141 | NC0155968 | 8 | 87.9 | 0.019127 | 0.099464 | C | Study 1 | CV130 | 291 | 1031 |
| 141 | NC0155968 | 8 | 87.9 | 0.022944 | 0.20092 | T | Study 1 | CV057 | 291 | 1031 |
| 141 | NC0144363 | 8 | 91.1 | 0.000818 | -0.08501 | G | Study 1 | CV057 | 437 | 1032 |
| 141 | NC0144363 | 8 | 91.1 | 0.011915 | 0.007566 | C | Study 1 | CV099 | 437 | 1032 |
| 141 | NC0145457 | 8 | 91.1 | 4.38E-08 | 0.160689 | A | Study 2 | -- | 453 | 1033 |
| 142 | NC0056860 | 8 | 92.1 | 0.0012 | 0.095519 | G | Study 3 | -- | 289 | 1034 |
| 142 | NC0056860 | 8 | 92.1 | -- | -- | G | Study 4 | -- | 289 | 1034 |
| 142 | NC0021895 | 8 | 92.2 | 0.010409 | 0.011209 | T | Study 1 | CV164 | 36 | 1035 |
| 142 | NC0021895 | 8 | 92.2 | 0 | 0.315445 | T | Study 1 | CV164 | 36 | 1035 |
| 142 | NC0021895 | 8 | 92.2 | 0.011048 | 0.009202 | C | Study 1 | I294213 | 36 | 1035 |
| 142 | NC0021895 | 8 | 92.2 | 0.000028 | -0.10819 | T | Study 1 | CV086 | 36 | 1035 |
| 142 | NC0032337 | 8 | 92.7 | 0.008039 | -0.01406 | GCTC | Study 1 | -- | 237 | 1036 |

CONT.

| QTL | Marker | Chr | pos | sig | effect | res allele | Mapping Study | Fav. Parent | SNP Position | SEQ ID |
|---|---|---|---|---|---|---|---|---|---|---|
| 142 | NC0032337 | 8 | 92.7 | 0.012727 | -0.01862 | GCTC | Study 1 | CV041 | 237 | 1036 |
| 142 | NC0032337 | 8 | 92.7 | 0.000241 | -0.0254 | GCTC | Study 1 | CV113 | 237 | 1036 |
| 142 | NC0048562 | 8 | 92.7 | 0.039154 | 0.064021 | G | Study 1 | CV114 | 217 | 1037 |
| 142 | NC0048562 | 8 | 92.7 | 0.027001 | 0.114611 | G | Study 1 | CV125 | 217 | 1037 |
| 142 | NC0082295 | 8 | 93.7 | 0.015336 | 0.017889 | T | Study 1 | CV065 | 251 | 1038 |
| 142 | NC0004253 | 8 | 93.9 | 0.00976 | -0.00684 | G | Study 1 | CV138 | 337 | 1039 |
| 142 | NC0004254 | 8 | 93.9 | --- | --- | G | Study 5 | --- | 165 | 1040 |
| 142 | NC0020514 | 8 | 93.9 | 0.035619 | -0.04789 | A | Study 1 | CV082 | 368 | 1041 |
| 142 | NC0020514 | 8 | 93.9 | 0.015489 | -0.04469 | A | Study 1 | CV041 | 368 | 1041 |
| 142 | NC0020514 | 8 | 93.9 | 0.002177 | -0.01779 | A | Study 1 | CV025 | 368 | 1041 |
| 142 | NC0004504 | 8 | 95.6 | 0.00267 | -0.0193 | A | Study 1 | CV047 | 469 | 1042 |
| 142 | NC0004504 | 8 | 95.6 | 0.000313 | -0.07538 | A | Study 1 | CV042 | 469 | 1042 |
| 142 | NC0004504 | 8 | 95.6 | 0.04012 | 0.090466 | A | Study 1 | CV166 | 469 | 1042 |
| 142 | NC0004504 | 8 | 95.6 | 0.002677 | -0.12136 | A | Study 1 | CV114 | 469 | 1042 |
| 142 | NC0004504 | 8 | 95.6 | 0.000048 | -0.24211 | C | Study 1 | --- | 469 | 1042 |
| 142 | NC0058047 | 8 | 96.1 | 0.042308 | -0.0085 | G | Study 1 | I294213 | 158 | 1043 |
| 142 | NC0058047 | 8 | 96.1 | 0.000007 | 0.203552 | G | Study 1 | CV118 | 158 | 1043 |
| 142 | NC0058047 | 8 | 96.1 | 0.023676 | 0.016044 | G | Study 1 | CV147 | 158 | 1043 |
| 142 | NC0104858 | 8 | 96.2 | 0.000009 | 0.19853 | GCT | Study 1 | CV118 | 173 | 1044 |
| 142 | NC0104858 | 8 | 96.2 | 0.025664 | 0.201515 | GCT | Study 1 | CV130 | 173 | 1044 |
| 142 | NC0104858 | 8 | 96.2 | 0.000585 | 0.015009 | *** | Study 1 | CV145 | 173 | 1044 |
| 142 | NC0012023 | 8 | 96.4 | 0.013954 | -0.08108 | G | Study 1 | CV017 | 439 | 1045 |
| 142 | NC0152566 | 8 | 97.2 | 0.004123 | -0.18107 | G | Study 1 | CV017 | 190 | 1046 |
| 142 | NC0152566 | 8 | 97.2 | 0.000165 | 0.150982 | G | Study 1 | CV114 | 190 | 1046 |
| 142 | NC0152566 | 8 | 97.2 | 0.000338 | -0.0305 | A | Study 1 | CV057 | 190 | 1046 |
| 143 | NC0107929 | 8 | 103.2 | 0.028876 | -0.07807 | G | Study 1 | CV041 | 341 | 1047 |
| 143 | NC0107929 | 8 | 103.2 | 0.006302 | -0.02033 | G | Study 1 | CV041 | 341 | 1047 |
| 143 | NC0105978 | 8 | 103.3 | 0.006537 | -0.01461 | A | Study 1 | CV086 | 193 | 1048 |
| 143 | NC0105978 | 8 | 103.3 | 0 | 0.396023 | G | Study 1 | CV164 | 193 | 1048 |
| 143 | NC0105978 | 8 | 103.3 | 0.000196 | 0.013335 | G | Study 1 | CV164 | 193 | 1048 |
| 143 | NC0105978 | 8 | 103.3 | 0.013799 | -0.06298 | G | Study 1 | CV057 | 193 | 1048 |
| 143 | NC0105978 | 8 | 103.3 | 0.000897 | -0.02039 | G | Study 1 | CV100 | 193 | 1048 |
| 143 | NC0105978 | 8 | 103.3 | 0.047039 | 0.019294 | G | Study 1 | CV143 | 193 | 1048 |

CONT.

| QTL | Marker | Chr | pos | sig | effect | res allele | Mapping Study | Fav. Parent | SNP Position | SEQ ID |
|---|---|---|---|---|---|---|---|---|---|---|
| 143 | NC0105978 | 8 | 103.3 | 0.026698 | -0.02535 | A | Study 1 | CV121 | 193 | 1048 |
| 143 | NC0105835 | 8 | 104 | 0.001029 | -0.08998 | C | Study 1 | CV082 | 275 | 1049 |
| 143 | NC0082386 | 8 | 108.5 | 0.026076 | -0.01437 | A | Study 1 | CV047 | 389 | 1050 |
| 143 | NC0082386 | 8 | 108.5 | 0.019569 | 0.014395 | G | Study 1 | CV013 | 389 | 1050 |
| 143 | NC0110684 | 8 | 111.2 | 0.038864 | 0.095006 | C | Study 1 | CV118 | 270 | 1051 |
| 144 | NC0112497 | 8 | 111.7 | <.0001 | -0.22623 | A | Study 3 | -- | 190 | 1052 |
| 144 | NC0112497 | 8 | 111.7 | 0.014785 | -0.01589 | A | Study 1 | CV047 | 190 | 1052 |
| 144 | NC0112497 | 8 | 111.7 | 0.011063 | 0.015643 | T | Study 1 | CV013 | 190 | 1052 |
| 144 | NC0112497 | 8 | 111.7 | 0.003472 | -0.01679 | A | Study 1 | CV025 | 190 | 1052 |
| 144 | NC0010392 | 8 | 115.4 | 0.007479 | -0.08363 | C | Study 1 | CV017 | 496 | 1053 |
| 144 | NC0010392 | 8 | 115.4 | 0.027483 | 0.020263 | A | Study 1 | CV143 | 496 | 1053 |
| 144 | NC0010392 | 8 | 115.4 | 0.016217 | -0.13696 | C | Study 1 | -- | 496 | 1053 |
| 144 | NC0010392 | 8 | 115.4 | 0.013996 | -0.0276 | G | Study 1 | CV121 | 496 | 1053 |
| 144 | NC0012656 | 8 | 115.6 | 0.001559 | -0.06723 | G | Study 1 | CV042 | 156 | 1054 |
| 144 | NC0012656 | 8 | 115.6 | 0.009374 | -0.06717 | A | Study 1 | CV057 | 156 | 1054 |
| 144 | NC0012656 | 8 | 115.6 | 0.016243 | -0.01705 | G | Study 1 | CV113 | 156 | 1054 |
| 144 | NC0020546 | 8 | 115.6 | 0.01566 | 0.018115 | A | Study 1 | CV065 | 51 | 1055 |
| 144 | NC0020546 | 8 | 115.6 | 0.028685 | -0.01284 | A | Study 1 | CV100 | 51 | 1055 |
| 144 | NC0008831 | 8 | 116.3 | 0 | 0.36804 | T | Study 1 | CV164 | 206 | 1056 |
| 144 | NC0008831 | 8 | 116.3 | 0.003104 | 0.010815 | T | Study 1 | CV164 | 206 | 1056 |
| 144 | NC0008831 | 8 | 116.3 | 0.001435 | 0.131497 | G | Study 1 | CV114 | 206 | 1056 |
| 144 | NC0153229 | 8 | 116.4 | 0.021369 | 0.017072 | A | Study 1 | CV065 | 49 | 1057 |
| 144 | NC0143432 | 8 | 117.9 | 0.000059 | -0.02134 | A | Study 1 | CV086 | 109 | 1058 |
| 144 | NC0173479 | 8 | 118.4 | -- | -- | G | Study 5 | -- | 650 | 1059 |
| 144 | NC0020537 | 8 | 118.6 | <.0001 | -0.24103 | C | Study 3 | -- | 140 | 1060 |
| 144 | NC0020537 | 8 | 118.6 | 0.016984 | -0.01612 | T | Study 1 | CV047 | 140 | 1060 |
| 145 | NC0004586 | 8 | 125.1 | 0.044915 | 0.012812 | A | Study 1 | CV013 | 64 | 1061 |
| 145 | NC0031630 | 8 | 125.1 | 0.018992 | -0.08743 | T | Study 1 | CV041 | 630 | 1062 |
| 146 | NC0010808 | 8 | 130.7 | 7.53E-06 | 0.126749 | G | Study 2 | -- | 473 | 1063 |
| 146 | NC0200202 | 8 | 133 | -- | -- | C | Study 5 | -- | 198 | 1064 |
| 146 | NC0005592 | 8 | 134.5 | 0.025875 | 0.016438 | C | Study 1 | CV065 | 305 | 1065 |
| 146 | NC0005592 | 8 | 134.5 | 0.025728 | -0.01178 | T | Study 1 | CV129 | 305 | 1065 |
| 146 | NC0013100 | 8 | 138.8 | 0.036521 | 0.114127 | C | Study 1 | -- | 284 | 1066 |

CONT.

| QTL | Marker | Chr | pos | sig | effect | res allele | Mapping Study | Fav. Parent | SNP Position | SEQ ID |
|---|---|---|---|---|---|---|---|---|---|---|
| 146 | NC0013100 | 8 | 138.8 | 0.045227 | 0.014756 | A | Study 1 | CV065 | 284 | 1066 |
| 146 | NC0013100 | 8 | 138.8 | 0 | 0.290089 | C | Study 1 | CV164 | 284 | 1066 |
| 146 | NC0013100 | 8 | 138.8 | 0.000684 | -0.02249 | A | Study 1 | CV113 | 284 | 1066 |
| 146 | NC0027810 | 8 | 139.4 | 0.025032 | 0.122741 | G | Study 1 | CV149 | 415 | 1067 |
| 146 | NC0027810 | 8 | 139.4 | 0.027739 | 0.013242 | A | Study 1 | CV013 | 415 | 1067 |
| 146 | NC0107286 | 8 | 139.7 | 0.000036 | -0.14578 | C | Study 1 | CV041 | 257 | 1068 |
| 146 | NC0107286 | 8 | 139.7 | 0.000508 | -0.06864 | C | Study 1 | CV042 | 257 | 1068 |
| 146 | NC0107286 | 8 | 139.7 | 0.005317 | 0.113675 | C | Study 1 | CV114 | 257 | 1068 |
| 146 | NC0108962 | 8 | 139.7 | 0.024761 | -0.00309 | G | Study 1 | CV120 | 238 | 1069 |
| 146 | NC0108962 | 8 | 139.7 | 0.024761 | -0.00309 | G | Study 1 | CV120 | 238 | 1069 |
| 147 | NC0145077 | 8 | 149.2 | 0.0003 | -0.3064 | A | Study 3 | -- | 463 | 1070 |
| 147 | NC0145077 | 8 | 149.2 | 0.0277 | 0.051923 | C | Study 1 | CV082 | 463 | 1070 |
| 147 | NC0145077 | 8 | 149.2 | 0.013547 | 0.100737 | A | Study 1 | CV114 | 463 | 1070 |
| 147 | NC0145077 | 8 | 149.2 | 0.008563 | -0.02177 | C | Study 1 | CV057 | 463 | 1070 |
| 147 | NC0145077 | 8 | 149.2 | 0.044981 | 0.065569 | A | Study 1 | CV150 | 463 | 1070 |
| 147 | NC0145298 | 8 | 149.2 | <.0001 | -0.36866 | G | Study 3 | -- | 56 | 1071 |
| 147 | NC0154802 | 8 | 149.2 | -- | -- | T | Study 5 | CV106 | 103 | 1072 |
| 147 | NC0154802 | 8 | 149.2 | 0.038649 | -0.02932 | T | Study 1 | -- | 103 | 1072 |
| 148 | NC0014545 | 8 | 155.1 | -- | -- | T | Study 5 | -- | 514 | 1073 |
| 148 | NC0014545 | 8 | 155.1 | 0.034238 | 0.009789 | T | Study 1 | CV096 | 514 | 1073 |
| 148 | NC0014566 | 8 | 155.1 | 0.019809 | 0.076395 | C | Study 1 | CV150 | 318 | 1074 |
| 148 | NC0008757 | 8 | 156.3 | 0.005119 | 0.154652 | C | Study 1 | CV164 | 274 | 1075 |
| 148 | NC0008757 | 8 | 156.3 | 0.002083 | 0.008381 | C | Study 1 | CV024 | 274 | 1075 |
| 148 | NC0008757 | 8 | 156.3 | 0.023447 | -0.01412 | T | Study 1 | CV113 | 274 | 1075 |
| 149 | NC0199880 | 8 | 161.8 | -- | -- | C | Study 5 | -- | 319 | 1076 |
| 149 | NC0000561 | 8 | 168.3 | 0.000265 | -0.13825 | C | Study 1 | CV041 | 71 | 1077 |
| 149 | NC0000561 | 8 | 168.3 | 0.010012 | 0.00744 | C | Study 1 | CV128 | 71 | 1077 |
| 149 | NC0000561 | 8 | 168.3 | 0.023042 | 0.035476 | A | Study 1 | CV066 | 71 | 1077 |
| 149 | NC0000561 | 8 | 168.3 | 0.005536 | -0.03112 | C | Study 1 | CV121 | 71 | 1077 |
| 149 | NC0000561 | 8 | 168.3 | 0.046099 | -0.01396 | C | Study 1 | CV041 | 71 | 1077 |
| 149 | NC0199956 | 8 | 169.9 | -- | -- | G | Study 5 | -- | 296 | 1078 |
| 150 | NC0014476 | 9 | 0.8 | -- | -- | G | Study 4 | -- | 187 | 1079 |
| 150 | NC0014476 | 9 | 0.8 | 0.02463 | -0.07899 | G | Study 1 | CV112 | 187 | 1079 |

CONT.

| QTL | Marker | Chr | pos | sig | effect | res allele | Mapping Study | Fav. Parent | SNP Position | SEQ ID |
|---|---|---|---|---|---|---|---|---|---|---|
| 150 | NC0014476 | 9 | 0.8 | 0.029373 | -0.00467 | C | Study 1 | CV092 | 187 | 1079 |
| 150 | NC0014476 | 9 | 0.8 | 0.029373 | -0.00467 | C | Study 1 | CV092 | 187 | 1079 |
| 150 | NC0014479 | 9 | 0.8 | -- | -- | T | Study 5 | -- | 309 | 1080 |
| 150 | NC0054684 | 9 | 8.3 | 0.008863 | 0.115482 | G | Study 4 | CV093 | 467 | 1081 |
| 150 | NC0054684 | 9 | 8.3 | 0.018107 | 0.012757 | G | Study 1 | -- | 467 | 1081 |
| 150 | NC0054684 | 9 | 8.3 | 0.003018 | -0.00645 | C | Study 1 | CV092 | 467 | 1081 |
| 150 | NC0054684 | 9 | 8.3 | 0.003018 | -0.00645 | C | Study 1 | CV092 | 467 | 1081 |
| 151 | NC0020781 | 9 | 16 | -- | -- | G | Study 5 | -- | 59 | 1082 |
| 151 | NC0020781 | 9 | 16 | 0.020015 | -0.08048 | A | Study 1 | CV017 | 59 | 1082 |
| 151 | NC0112118 | 9 | 16 | 0.009952 | -0.08954 | C | Study 1 | CV017 | 601 | 1083 |
| 151 | NC0173738 | 9 | 17.4 | -- | -- | T | Study 5 | -- | 661 | 1084 |
| 151 | NC0002735 | 9 | 17.6 | 0.006619 | -0.03316 | G | Study 4 | CV072 | 86 | 1085 |
| 151 | NC0002735 | 9 | 17.6 | 0.032986 | -0.05282 | A | Study 1 | I294213 | 86 | 1085 |
| 151 | NC0002735 | 9 | 17.6 | 0.000153 | -0.00852 | G | Study 1 | CV092 | 86 | 1085 |
| 151 | NC0002735 | 9 | 17.6 | 0.000153 | -0.00852 | G | Study 1 | CV092 | 86 | 1085 |
| 151 | NC0113434 | 9 | 19.6 | -- | -- | T | Study 4 | -- | 352 | 1086 |
| 151 | NC0113434 | 9 | 19.6 | 0.000141 | -0.00871 | T | Study 1 | CV092 | 352 | 1086 |
| 151 | NC0113434 | 9 | 19.6 | 0.000141 | -0.00871 | T | Study 1 | CV092 | 352 | 1086 |
| 152 | NC0049557 | 9 | 25.7 | <.0001 | 0.203886 | G | Study 3 | -- | 464 | 1087 |
| 152 | NC0049557 | 9 | 25.7 | 0.013714 | -0.06091 | G | Study 1 | I294213 | 464 | 1087 |
| 152 | NC0049557 | 9 | 25.7 | 0.040858 | -0.0125 | G | Study 1 | CV013 | 464 | 1087 |
| 153 | NC0012830 | 9 | 33.1 | 0.048968 | 0.019894 | A | Study 1 | CV152 | 334 | 1088 |
| 153 | NC0012830 | 9 | 33.1 | 0.034933 | 0.015661 | G | Study 1 | CV048 | 334 | 1088 |
| 153 | NC0012830 | 9 | 33.1 | 0.002312 | -0.10472 | A | Study 1 | CV017 | 334 | 1088 |
| 153 | NC0012830 | 9 | 33.1 | 0.007593 | 0.113205 | G | Study 1 | CV125 | 334 | 1088 |
| 153 | NC0012830 | 9 | 33.1 | 0.007313 | -0.019 | A | Study 1 | CV010 | 334 | 1088 |
| 153 | NC0012830 | 9 | 33.1 | 0.016289 | -0.07906 | G | Study 1 | CV119 | 334 | 1088 |
| 153 | NC0060553 | 9 | 33.2 | -- | -- | A | Study 5 | -- | 299 | 1089 |
| 153 | NC0004308 | 9 | 36 | 0.0005579 | -0.12292 | T | Study 4 | -- | 439 | 1090 |
| 153 | NC0148121 | 9 | 36.6 | 0.0005579 | -0.12292 | T | Study 1 | CV017 | 349 | 1091 |
| 154 | NC0027914 | 9 | 45 | 0.038706 | -0.00574 | A | Study 1 | CV022 | 211 | 1092 |

CONT.

| QTL | Marker | Chr | pos | sig | effect | res allele | Mapping Study | Fav. Parent | SNP Position | SEQ ID |
|---|---|---|---|---|---|---|---|---|---|---|
| 154 | NC0027914 | 9 | 45 | 0.002498 | 0.076898 | G | Study 1 | CV112 | 211 | 1092 |
| 154 | NC0025198 | 9 | 45.7 | 0.036256 | -0.00704 | T | Study 1 | I294213 | 289 | 1093 |
| 154 | NC0025198 | 9 | 45.7 | 0.015361 | -0.01723 | C | Study 1 | CV010 | 289 | 1093 |
| 154 | NC0025198 | 9 | 45.7 | 0.026887 | -0.27789 | T | Study 1 | CV130 | 289 | 1093 |
| 154 | NC0025198 | 9 | 45.7 | 0.005793 | -0.25405 | C | Study 1 | CV047 | 289 | 1093 |
| 154 | NC0029745 | 9 | 45.7 | -- | -- | G | Study 4 | -- | 1023 | 1094 |
| 154 | NC0041796 | 9 | 46.5 | 0.038782 | -0.11222 | G | Study 1 | I294213 | 59 | 1095 |
| 154 | NC0029583 | 9 | 49.1 | 0.037234 | 0.013643 | A | Study 1 | -- | 76 | 1096 |
| 155 | NC0029436 | 9 | 51.5 | -- | -- | G | Study 4 | -- | 504 | 1097 |
| 155 | NC0029436 | 9 | 51.5 | 0.004685 | 0.120941 | C | Study 1 | CV125 | 504 | 1097 |
| 155 | NC0029436 | 9 | 51.5 | 0.00267 | -0.02009 | G | Study 1 | CV113 | 504 | 1097 |
| 155 | NC0028095 | 9 | 59.4 | -- | -- | T | Study 4 | -- | 116 | 1098 |
| 155 | NC0028095 | 9 | 59.4 | 0.004658 | 0.018219 | C | Study 1 | CV011 | 116 | 1098 |
| 155 | NC0028095 | 9 | 59.4 | 0.043833 | 0.118855 | C | Study 1 | CV070 | 116 | 1098 |
| 156 | NC0010643 | 9 | 60.6 | 0.018718 | -0.1101 | G | Study 1 | CV067 | 184 | 1099 |
| 156 | NC0010643 | 9 | 60.6 | 0.020177 | -0.0121 | A | Study 1 | CV136 | 184 | 1099 |
| 156 | NC0055759 | 9 | 62.1 | 0.039005 | -0.00847 | T | Study 1 | CV095 | 149 | 1100 |
| 156 | NC0018302 | 9 | 65.1 | 0.0038 | 0.098649 | G | Study 3 | -- | 290 | 1101 |
| 156 | NC0018302 | 9 | 65.1 | 0.006013 | -0.09183 | A | Study 1 | CV017 | 290 | 1101 |
| 156 | NC0031233 | 9 | 66.5 | 0.000453 | -0.31096 | A | Study 1 | CV047 | 1054 | 1102 |
| 156 | NC0109526 | 9 | 66.5 | 0.005517 | 0.262734 | C | Study 1 | CV109 | 297 | 1103 |
| 156 | NC0144042 | 9 | 66.5 | 0.00706 | 0.085654 | C | Study 1 | CV116 | 130 | 1104 |
| 156 | NC0144042 | 9 | 66.5 | 0.000297 | 0.091533 | C | Study 1 | CV112 | 130 | 1104 |
| 156 | NC0004407 | 9 | 67.2 | -- | -- | G | Study 4 | -- | 49 | 1105 |
| 156 | NC0004407 | 9 | 67.2 | 0.03039 | -0.01503 | G | Study 1 | CV108 | 49 | 1105 |
| 156 | NC0028527 | 9 | 67.5 | 0.022612 | -0.01429 | A | Study 1 | CV013 | 351 | 1106 |
| 156 | NC0104195 | 9 | 68.5 | 0.003043 | 0.125578 | A | Study 1 | CV125 | 225 | 1107 |
| 156 | NC0106791 | 9 | 68.5 | -- | -- | T | Study 4 | -- | 181 | 1108 |
| 156 | NC0108984 | 9 | 68.5 | -- | -- | G | Study 5 | -- | 562 | 1109 |
| 156 | NC0110377 | 9 | 68.5 | 0.039799 | -0.06781 | T | Study 1 | CV119 | 538 | 1110 |
| 157 | NC0031039 | 9 | 70.9 | 0.000112 | -0.11761 | C | Study 1 | CV064 | 351 | 1111 |
| 157 | NC0009397 | 9 | 72.6 | 0.020725 | -0.01459 | C | Study 1 | CV095 | 311 | 1112 |
| 157 | NC0009397 | 9 | 72.6 | 0.041364 | -0.00846 | C | Study 1 | CV095 | 311 | 1112 |

CONT.

| QTL | Marker | Chr | pos | sig | effect | res allele | Mapping Study | Fav. Parent | SNP Position | SEQ ID |
|---|---|---|---|---|---|---|---|---|---|---|
| 157 | NC0021430 | 9 | 74.2 | 0.005569 | -0.1319 | C | Study 1 | CV067 | 215 | 1113 |
| 157 | NC0112189 | 9 | 76.2 | 0.040855 | -0.1157 | G | Study 1 | I294213 | 479 | 1114 |
| 157 | NC0020048 | 9 | 77.5 | 0.0046 | 0.104102 | G | Study 3 | -- | 414 | 1115 |
| 157 | NC0153427 | 9 | 77.5 | -- | -- | T | Study 5 | -- | 74 | 1116 |
| 157 | NC0199943 | 9 | 79.2 | -- | -- | G | Study 5 | -- | 250 | 1117 |
| 157 | NC0199722 | 9 | 79.6 | -- | -- | G | Study 5 | -- | 283 | 1118 |
| 158 | NC0111177 | 9 | 80.1 | 0.000916 | -0.11078 | G | Study 1 | CV017 | 365 | 1119 |
| 158 | NC0171446 | 9 | 80.1 | -- | -- | T | Study 5 | -- | 462 | 1120 |
| 158 | NC0014826 | 9 | 81.8 | 0.010378 | 0.018293 | C | Study 1 | CV165 | 51 | 1121 |
| 158 | NC0014826 | 9 | 81.8 | 0.00023 | -0.35545 | C | Study 1 | CV047 | 51 | 1121 |
| 158 | NC0002383 | 9 | 83.3 | 0.014206 | 0.069466 | A | Study 1 | CV116 | 63 | 1122 |
| 158 | NC0052822 | 9 | 83.4 | -- | -- | G | Study 5 | -- | 541 | 1123 |
| 158 | NC0110125 | 9 | 83.4 | 0.013478 | -0.01558 | G | Study 1 | CV013 | 420 | 1124 |
| 158 | NC0174154 | 9 | 84.1 | -- | -- | G | Study 5 | -- | 1001 | 1125 |
| 158 | NC0200114 | 9 | 84.1 | -- | -- | G | Study 5 | -- | 72 | 1126 |
| 158 | NC0003425 | 9 | 84.5 | -- | -- | G | Study 5 | -- | 280 | 1127 |
| 158 | NC0003425 | 9 | 84.5 | 0.004719 | 0.016346 | C | Study 1 | CV150 | 280 | 1127 |
| 158 | NC0003425 | 9 | 84.5 | 0.032551 | -0.11659 | G | Study 1 | I294213 | 280 | 1127 |
| 158 | NC0023268 | 9 | 84.5 | -- | -- | G | Study 5 | -- | 117 | 1128 |
| 158 | NC0038548 | 9 | 84.5 | -- | -- | T | Study 5 | -- | 312 | 1129 |
| 158 | NC0147496 | 9 | 84.5 | 0.013491 | -0.0346 | G | Study 1 | CV106 | 526 | 1130 |
| 158 | NC0004123 | 9 | 84.6 | -- | -- | T | Study 5 | -- | 384 | 1131 |
| 158 | NC0004123 | 9 | 84.6 | 0.043239 | 0.059168 | C | Study 1 | CV150 | 384 | 1131 |
| 158 | NC0078438 | 9 | 84.6 | 0.036554 | 0.013475 | C | Study 1 | CV011 | 138 | 1132 |
| 158 | NC0013086 | 9 | 87.3 | 0.012503 | -0.01685 | A | Study 1 | CV021 | 343 | 1133 |
| 158 | NC0013086 | 9 | 87.3 | 0.007289 | -0.13785 | A | Study 1 | CV067 | 343 | 1133 |
| 158 | NC0013086 | 9 | 87.3 | 0.030764 | 0.048571 | A | Study 1 | -- | 343 | 1133 |
| 158 | NC0013086 | 9 | 87.3 | 0.023963 | -0.18109 | G | Study 1 | I294213 | 343 | 1133 |
| 158 | NC0013086 | 9 | 87.3 | 0.000523 | 0.145738 | A | Study 1 | CV125 | 343 | 1133 |
| 158 | NC0013086 | 9 | 87.3 | 0.000226 | 0.01823 | A | Study 1 | -- | 343 | 1133 |
| 159 | NC0081074 | 9 | 90.4 | <.0001 | -0.21669 | C | Study 3 | -- | 390 | 1134 |
| 159 | NC0081074 | 9 | 90.4 | 0.038721 | -0.06972 | C | Study 1 | CV017 | 390 | 1134 |
| 159 | NC0081074 | 9 | 90.4 | 0.000515 | -0.10568 | T | Study 1 | CV064 | 390 | 1134 |

CONT.

| QTL | Marker | Chr | pos | sig | effect | res allele | Mapping Study | Fav. Parent | SNP Position | SEQ ID |
|---|---|---|---|---|---|---|---|---|---|---|
| 159 | NC0199525 | 9 | 90.9 | -- | -- | G | Study 5 | -- | 121 | 1135 |
| 159 | NC0108275 | 9 | 91.6 | 0.042042 | 0.075411 | T | Study 1 | CV162 | 401 | 1136 |
| 159 | NC0108275 | 9 | 91.6 | 0.000617 | 0.143921 | A | Study 1 | CV125 | 401 | 1136 |
| 159 | NC0108275 | 9 | 91.6 | 0.000417 | 0.017898 | T | Study 1 | -- | 401 | 1136 |
| 159 | NC0108275 | 9 | 91.6 | 0.02395 | -0.18611 | T | Study 1 | CV044 | 401 | 1136 |
| 159 | NC0108275 | 9 | 91.6 | 0.014306 | -0.01569 | T | Study 1 | CV013 | 401 | 1136 |
| 159 | NC0148459 | 9 | 91.7 | 0.044456 | -0.00359 | C | Study 1 | CV094 | 258 | 1137 |
| 159 | NC0028613 | 9 | 94.6 | -- | -- | G | Study 5 | -- | 167 | 1138 |
| 159 | NC0153579 | 9 | 97.3 | 0.00867 | 0.018237 | G | Study 1 | CV165 | 1001 | 1139 |
| 159 | NC0004890 | 9 | 98.4 | <.0001 | -0.17083 | A | Study 3 | -- | 104 | 1140 |
| 159 | NC0057097 | 9 | 98.4 | 0.003895 | -0.29326 | ******** | Study 1 | CV047 | 209 | 1141 |
| 159 | NC0106442 | 9 | 98.4 | 0.0057 | 0.132784 | G | Study 3 | -- | 172 | 1142 |
| 159 | NC0106442 | 9 | 98.4 | 0.030984 | -0.01384 | A | Study 3 | CV021 | 172 | 1142 |
| 159 | NC0106442 | 9 | 98.4 | 0.008693 | 0.013409 | A | Study 1 | -- | 172 | 1142 |
| 160 | NC0041196 | 9 | 101.5 | -- | -- | G | Study 4 | -- | 835 | 1143 |
| 160 | NC0041196 | 9 | 101.5 | 0.017498 | 0.013592 | G | Study 1 | CV150 | 835 | 1143 |
| 160 | NC0041196 | 9 | 101.5 | 0.018747 | 0.029313 | G | Study 1 | CV132 | 835 | 1143 |
| 160 | NC0041196 | 9 | 101.5 | 0.003921 | 0.110028 | G | Study 1 | CV162 | 835 | 1143 |
| 160 | NC0041196 | 9 | 101.5 | 0.006328 | 0.190326 | G | Study 1 | CV149 | 835 | 1143 |
| 160 | NC0041196 | 9 | 101.5 | 0.041725 | -0.01374 | G | Study 1 | CV077 | 835 | 1143 |
| 160 | NC0021860 | 9 | 101.8 | 0.035215 | -0.06399 | G | Study 1 | CV017 | 90 | 1144 |
| 160 | NC0042348 | 9 | 101.8 | -- | -- | A | Study 4 | -- | 103 | 1145 |
| 160 | NC0042348 | 9 | 101.8 | 0.034709 | -0.0155 | A | Study 1 | CV039 | 103 | 1145 |
| 160 | NC0042348 | 9 | 101.8 | 0.045059 | 0.007284 | A | Study 1 | CV101 | 103 | 1145 |
| 160 | NC0042348 | 9 | 101.8 | 0.000569 | -0.10482 | G | Study 1 | CV064 | 103 | 1145 |
| 160 | NC0042348 | 9 | 101.8 | 0.006059 | -0.06772 | G | Study 1 | I294213 | 103 | 1145 |
| 160 | NC0042348 | 9 | 101.8 | 0.003182 | 0.015539 | A | Study 1 | -- | 103 | 1145 |
| 160 | NC0018417 | 9 | 102.1 | 0.0004 | 0.106203 | C | Study 3 | -- | 287 | 1146 |
| 160 | NC0018417 | 9 | 102.1 | 0.042932 | -0.10903 | A | Study 1 | I294213 | 287 | 1146 |
| 160 | NC0014240 | 9 | 103.5 | -- | -- | G | Study 5 | -- | 525 | 1147 |
| 160 | NC0066389 | 9 | 105.5 | -- | -- | G | Study 4 | -- | 161 | 1148 |
| 160 | NC0066389 | 9 | 105.5 | 0.014954 | 0.003261 | G | Study 1 | CV016 | 161 | 1148 |
| 160 | NC0066389 | 9 | 105.5 | 0.014954 | 0.003261 | G | Study 1 | CV016 | 161 | 1148 |

CONT.

| QTL | Marker | Chr | pos | sig | effect | res allele | Mapping Study | Fav. Parent | SNP Position | SEQ ID |
|---|---|---|---|---|---|---|---|---|---|---|
| 160 | NC0066390 | 9 | 105.5 | 0.04712 | -0.01314 | A | Study 1 | CV021 | 179 | 1149 |
| 160 | NC0066390 | 9 | 105.5 | 0.030923 | -0.00354 | A | Study 1 | CV094 | 179 | 1149 |
| 160 | NC0066390 | 9 | 105.5 | 0.002599 | 0.015718 | A | Study 1 | -- | 179 | 1149 |
| 160 | NC0036022 | 9 | 107.9 | 0.0029 | 0.125806 | G | Study 1 | CV125 | 78 | 1150 |
| 160 | NC0036022 | 9 | 107.9 | 0.011758 | -0.20572 | C | Study 1 | CV044 | 78 | 1150 |
| 161 | NC0016689 | 9 | 110.4 | 0.034867 | 0.015865 | T | Study 1 | CV048 | 324 | 1151 |
| 161 | NC0016689 | 9 | 110.4 | 0.028536 | -0.10411 | C | Study 1 | CV067 | 324 | 1151 |
| 161 | NC0018446 | 9 | 110.4 | 0.030979 | -0.01502 | A | Study 1 | CV021 | 338 | 1152 |
| 161 | NC0018446 | 9 | 110.4 | 0.015527 | -0.0081 | G | Study 1 | CV080 | 338 | 1152 |
| 161 | NC0018446 | 9 | 110.4 | 0.007553 | 0.010202 | A | Study 1 | CV101 | 338 | 1152 |
| 161 | NC0018446 | 9 | 110.4 | 0.013718 | -0.13359 | G | Study 1 | I294213 | 338 | 1152 |
| 161 | NC0018446 | 9 | 110.4 | 0.01389 | 0.01508 | A | Study 1 | CV079 | 338 | 1152 |
| 161 | NC0018446 | 9 | 110.4 | 0.008694 | 0.014304 | A | Study 1 | -- | 338 | 1152 |
| 161 | NC0018446 | 9 | 110.4 | 0.006114 | -0.01737 | G | Study 1 | CV013 | 338 | 1152 |
| 161 | NC0035380 | 9 | 110.4 | 0.04682 | 0.088991 | A | Study 1 | CV013 | 222 | 1153 |
| 161 | NC0199636 | 9 | 112 | -- | -- | G | Study 5 | -- | 264 | 1154 |
| 161 | NC0151505 | 9 | 114.5 | 0.00563 | 0.016235 | G | Study 1 | CV150 | 117 | 1155 |
| 161 | NC0151505 | 9 | 114.5 | 0.024034 | -0.04788 | C | Study 1 | CV042 | 117 | 1155 |
| 161 | NC0029176 | 9 | 116 | 0.041761 | -0.00531 | C | Study 1 | CV056 | 176 | 1156 |
| 161 | NC0037029 | 9 | 119.9 | -- | -- | G | Study 5 | -- | 396 | 1157 |
| 162 | NC0035729 | 9 | 120.3 | 0.025844 | 0.00305 | C | Study 1 | CV016 | 102 | 1158 |
| 162 | NC0035729 | 9 | 120.3 | 0.025844 | 0.00305 | C | Study 1 | CV016 | 102 | 1158 |
| 162 | NC0039475 | 9 | 122.7 | -- | -- | T | Study 4 | -- | 267 | 1159 |
| 162 | NC0039475 | 9 | 122.7 | 0.027694 | -0.01578 | T | Study 1 | CV112 | 267 | 1159 |
| 163 | NC0042929 | 9 | 130 | -- | -- | G | Study 4 | -- | 550 | 1160 |
| 163 | NC0042929 | 9 | 130 | 0.026699 | -0.12082 | G | Study 1 | I294213 | 550 | 1160 |
| 163 | NC0042929 | 9 | 130 | 0.01827 | 0.171014 | C | Study 1 | CV129 | 550 | 1160 |
| 163 | NC0111292 | 9 | 131.1 | 0.010997 | 0.014821 | C | Study 1 | CV150 | 168 | 1161 |
| 163 | NC0111292 | 9 | 131.1 | 0.020927 | 0.017237 | C | Study 1 | CV048 | 168 | 1161 |
| 163 | NC0111292 | 9 | 131.1 | 0.038733 | -0.00523 | G | Study 1 | CV056 | 168 | 1161 |
| 163 | NC0111292 | 9 | 131.1 | 0.001383 | 0.052787 | C | Study 1 | CV054 | 168 | 1161 |
| 163 | NC0111292 | 9 | 131.1 | 0.027549 | 0.159768 | C | Study 1 | CV129 | 168 | 1161 |
| 163 | NC0111292 | 9 | 131.1 | 0.03618 | -0.01349 | G | Study 1 | CV013 | 168 | 1161 |

CONT.

| QTL | Marker | Chr | pos | sig | effect | res allele | Mapping Study | Fav. Parent | SNP Position | SEQ ID |
|---|---|---|---|---|---|---|---|---|---|---|
| 163 | NC0009407 | 9 | 133.5 | 0.022785 | -0.04389 | G | Study 1 | CV042 | 290 | 1162 |
| 163 | NC0009407 | 9 | 133.5 | 0.037566 | -0.00484 | G | Study 1 | CV092 | 290 | 1162 |
| 163 | NC0009407 | 9 | 133.5 | 0.037566 | -0.00484 | G | Study 1 | CV092 | 290 | 1162 |
| 163 | NC0026895 | 9 | 133.5 | 0.027958 | 0.244518 | T | Study 1 | CV124 | 244 | 1163 |
| 163 | NC0083647 | 9 | 136.7 | <.0001 | 0.22023 | G | Study 3 | -- | 375 | 1164 |
| 163 | NC0083647 | 9 | 136.7 | 0.02224 | 0.01017 | A | Study 1 | -- | 375 | 1164 |
| 164 | NC0077194 | 9 | 147.7 | -- | -- | T | Study 5 | -- | 204 | 1165 |
| 164 | NC0077194 | 9 | 147.7 | 0.007001 | -0.05096 | A | Study 1 | CV042 | 204 | 1165 |
| 164 | NC0077194 | 9 | 147.7 | 0.04168 | 0.009028 | A | Study 1 | -- | 204 | 1165 |
| 164 | NC0077194 | 9 | 147.7 | 0.033341 | 0.134379 | T | Study 1 | CV073 | 204 | 1165 |
| 165 | NC0049286 | 9 | 153 | -- | -- | G | Study 4 | -- | 149 | 1166 |
| 165 | NC0049286 | 9 | 153 | 0.009925 | 0.190716 | G | Study 1 | CV129 | 149 | 1166 |
| 165 | NC0049286 | 9 | 153 | 0.014355 | -0.13436 | C | Study 1 | I294213 | 149 | 1166 |
| 165 | NC0049286 | 9 | 153 | 0.00504 | -0.01777 | C | Study 1 | CV013 | 149 | 1166 |
| 165 | NC0147417 | 9 | 153.2 | 0.0011 | -0.10846 | C | Study 3 | -- | 77 | 1167 |
| 165 | NC0147417 | 9 | 153.2 | 0.003761 | -0.07459 | C | Study 1 | CV011 | 77 | 1167 |
| 165 | NC0147417 | 9 | 153.2 | 0.027365 | 0.124325 | C | Study 1 | CV160 | 77 | 1167 |
| 166 | NC0020088 | 10 | 8.6 | 0.000834 | -0.18941 | GGAATAACT | Study 1 | CV053 | 267 | 1168 |
| 166 | NC0020088 | 10 | 8.6 | 0 | 0.199296 | GGAATAACT | Study 1 | CV053 | 267 | 1168 |
| 166 | NC0020088 | 10 | 8.6 | 0.016207 | -0.05899 | GGAATAACT | Study 1 | CV011 | 267 | 1168 |
| 166 | NC0020088 | 10 | 8.6 | 0.017509 | -0.10696 | GGAATAACT | Study 1 | CV067 | 267 | 1168 |
| 166 | NC0020088 | 10 | 8.6 | 0.037715 | 0.128985 | GGAATAACT | Study 1 | CV073 | 267 | 1168 |
| 166 | NC0020088 | 10 | 8.6 | 0.047779 | -0.08156 | GGAATAACT | Study 1 | CV045 | 267 | 1168 |
| 166 | NC0020088 | 10 | 8.6 | 0.000589 | -0.24885 | GGAATAACT | Study 1 | I294213 | 267 | 1168 |
| 166 | NC0020088 | 10 | 8.6 | 0.000163 | 0.382718 | GGAATAACT | Study 1 | CV161 | 267 | 1168 |
| 167 | NC0153987 | 10 | 23.5 | 0.048224 | 0.008239 | C | Study 1 | CV081 | 482 | 1169 |
| 167 | NC0153632 | 10 | 24.1 | -- | -- | T | Study 4 | -- | 93 | 1170 |
| 167 | NC0153632 | 10 | 24.1 | 0.030649 | -0.00526 | T | Study 1 | I294213 | 93 | 1170 |
| 167 | NC0153632 | 10 | 24.1 | 0.000029 | -0.22815 | T | Study 1 | CV053 | 93 | 1170 |
| 167 | NC0153632 | 10 | 24.1 | 0 | 0.252924 | T | Study 1 | CV053 | 93 | 1170 |
| 167 | NC0153632 | 10 | 24.1 | 0.001318 | -0.01607 | T | Study 1 | CV053 | 93 | 1170 |
| 167 | NC0153632 | 10 | 24.1 | 0.026518 | 0.063755 | T | Study 1 | CV131 | 93 | 1170 |
| 167 | NC0153632 | 10 | 24.1 | 0.001902 | -0.01454 | T | Study 1 | CV098 | 93 | 1170 |

CONT.

| QTL | Marker | Chr | pos | sig | effect | res allele | Mapping Study | Fav. Parent | SNP Position | SEQ ID |
|---|---|---|---|---|---|---|---|---|---|---|
| 167 | NC0153632 | 10 | 24.1 | 0.027 | 0.099188 | G | Study 1 | CV093 | 93 | 1170 |
| 167 | NC0153632 | 10 | 24.1 | 0.011133 | 0.039793 | T | Study 1 | CV066 | 93 | 1170 |
| 167 | NC0153632 | 10 | 24.1 | 0.024937 | -0.13418 | T | Study 1 | I294213 | 93 | 1170 |
| 167 | NC0153632 | 10 | 24.1 | 0.019597 | 0.017967 | G | Study 1 | CV150 | 93 | 1170 |
| 167 | NC0153632 | 10 | 24.1 | 0.037834 | 0.013127 | G | Study 1 | CV150 | 93 | 1170 |
| 167 | NC0173382 | 10 | 27.7 | -- | -- | G | Study 5 | -- | 149 | 1171 |
| 167 | NC0016033 | 10 | 29.2 | 0.000128 | -0.22143 | G | Study 1 | CV053 | 110 | 1172 |
| 167 | NC0016033 | 10 | 29.2 | 0.006965 | -0.01313 | G | Study 1 | CV053 | 110 | 1172 |
| 167 | NC0016033 | 10 | 29.2 | 0.033138 | 0.087934 | G | Study 1 | CV125 | 110 | 1172 |
| 168 | NC0019023 | 10 | 30.3 | -- | -- | C | Study 5 | -- | 479 | 1173 |
| 168 | NC0020502 | 10 | 30.3 | 0.000001 | 0.167617 | G | Study 1 | CV053 | 172 | 1174 |
| 168 | NC0020502 | 10 | 30.3 | 0 | 0.082774 | G | Study 1 | CV054 | 172 | 1174 |
| 168 | NC0020502 | 10 | 30.3 | 0.041806 | 0.013597 | G | Study 1 | CV049 | 172 | 1174 |
| 168 | NC0020502 | 10 | 30.3 | 0.001169 | 0.414728 | G | Study 1 | CV156 | 172 | 1174 |
| 168 | NC0020502 | 10 | 30.3 | 0.00354 | 0.024859 | G | Study 1 | CV161 | 172 | 1174 |
| 168 | NC0020502 | 10 | 30.3 | 0.017509 | 0.222149 | A | Study 1 | CV130 | 172 | 1174 |
| 168 | NC0020502 | 10 | 30.3 | 0.000788 | 0.292645 | G | Study 1 | CV161 | 172 | 1174 |
| 168 | NC0020502 | 10 | 30.3 | 0.034306 | 0.070091 | A | Study 1 | CV150 | 172 | 1174 |
| 168 | NC0009645 | 10 | 32.1 | 0.020581 | -0.06974 | G | Study 2 | -- | 225 | 1175 |
| 168 | NC0009645 | 10 | 32.1 | 0.041162 | -0.02033 | G | Study 1 | I294213 | 225 | 1175 |
| 168 | NC0009645 | 10 | 32.1 | 0.029063 | -0.0134 | A | Study 1 | CV044 | 225 | 1175 |
| 168 | NC0009645 | 10 | 32.1 | 0.011382 | 0.041189 | A | Study 1 | CV066 | 225 | 1175 |
| 168 | NC0009645 | 10 | 32.1 | 0.005886 | 0.025674 | A | Study 1 | CV062 | 225 | 1175 |
| 168 | NC0009645 | 10 | 32.1 | 0.017654 | 0.019373 | G | Study 1 | CV069 | 225 | 1175 |
| 168 | NC0104672 | 10 | 32.2 | -- | -- | C | Study 5 | -- | 125 | 1176 |
| 168 | NC0104672 | 10 | 32.2 | 0.018464 | 0.085446 | C | Study 1 | CV109 | 125 | 1176 |
| 168 | NC0104672 | 10 | 32.2 | 0.000698 | -0.13656 | C | Study 1 | CV045 | 125 | 1176 |
| 168 | NC0111682 | 10 | 36.7 | 0.046957 | -0.0148 | C | Study 1 | CV039 | 77 | 1177 |
| 169 | NC0008956 | 10 | 40.8 | 0.000634 | -0.1413 | A | Study 1 | CV045 | 447 | 1178 |
| 169 | NC0008956 | 10 | 40.8 | 0.007388 | 0.089829 | T | Study 1 | CV150 | 447 | 1178 |
| 169 | NC0016045 | 10 | 43.7 | 0.005738 | -0.1294 | G | Study 1 | CV067 | 113 | 1179 |
| 169 | NC0016045 | 10 | 43.7 | 0.000579 | 0.062844 | A | Study 1 | CV054 | 113 | 1179 |
| 169 | NC0016045 | 10 | 43.7 | 0.009408 | -0.11512 | G | Study 1 | CV100 | 113 | 1179 |

CONT.

| QTL | Marker | Chr | pos | sig | effect | res allele | Mapping Study | Fav. Parent | SNP Position | SEQ ID |
|---|---|---|---|---|---|---|---|---|---|---|
| 169 | NC0028604 | 10 | 43.7 | <.0001 | 0.138728 | T | Study 3 | -- | 248 | 1180 |
| 169 | NC0028604 | 10 | 43.7 | 0.011169 | -0.13561 | T | Study 1 | CV053 | 248 | 1180 |
| 169 | NC0028604 | 10 | 43.7 | 0.021652 | -0.10617 | C | Study 1 | CV067 | 248 | 1180 |
| 169 | NC0028604 | 10 | 43.7 | 0.030098 | 0.075637 | T | Study 1 | CV053 | 248 | 1180 |
| 169 | NC0028604 | 10 | 43.7 | 0.036209 | 0.016705 | C | Study 1 | CV069 | 248 | 1180 |
| 169 | NC0005255 | 10 | 45 | 0.002 | -0.1295 | A | Study 3 | -- | 128 | 1181 |
| 169 | NC0005255 | 10 | 45 | 0.002613 | -0.01813 | C | Study 1 | CV044 | 128 | 1181 |
| 169 | NC0015355 | 10 | 45.2 | -- | -- | G | Study 3 | -- | 458 | 1182 |
| 169 | NC0111212 | 10 | 45.9 | -- | -- | G | Study 5 | -- | 166 | 1183 |
| 169 | NC0111212 | 10 | 45.9 | 0.001975 | 0.028698 | G | Study 1 | CV062 | 166 | 1183 |
| 169 | NC0111212 | 10 | 45.9 | 0.004541 | 0.276584 | G | Study 1 | CV130 | 166 | 1183 |
| 169 | NC0143762 | 10 | 46.7 | 0.016189 | 0.010981 | A | Study 1 | -- | 267 | 1184 |
| 169 | NC0143762 | 10 | 46.7 | 0.000816 | 0.027097 | A | Study 1 | CV156 | 267 | 1184 |
| 169 | NC0143762 | 10 | 46.7 | 0.000001 | 0.041456 | A | Study 1 | CV161 | 267 | 1184 |
| 169 | NC0143762 | 10 | 46.7 | 0.000007 | 0.02589 | A | Study 1 | -- | 267 | 1184 |
| 169 | NC0143762 | 10 | 46.7 | 0.014041 | 0.011861 | A | Study 1 | -- | 267 | 1184 |
| 169 | NC0143762 | 10 | 46.7 | 0.013345 | 0.012708 | A | Study 3 | -- | 267 | 1184 |
| 169 | NC0053602 | 10 | 47.3 | 0.0005 | -0.12392 | G | Study 5 | -- | 339 | 1185 |
| 169 | NC0053602 | 10 | 47.3 | -- | -- | G | Study 1 | CV134 | 339 | 1185 |
| 169 | NC0053602 | 10 | 47.3 | 0.019961 | 0.025142 | T | Study 1 | -- | 339 | 1185 |
| 169 | NC0147718 | 10 | 47.3 | -- | -- | T | Study 5 | -- | 261 | 1186 |
| 169 | NC0148322 | 10 | 47.3 | -- | -- | T | Study 5 | -- | 71 | 1187 |
| 169 | NC0173834 | 10 | 49.1 | -- | -- | T | Study 5 | -- | 635 | 1188 |
| 169 | NC0199686 | 10 | 49.1 | -- | -- | T | Study 5 | -- | 70 | 1189 |
| 169 | NC0109058 | 10 | 49.2 | 0.036137 | 0.042498 | T | Study 1 | -- | 315 | 1190 |
| 169 | NC0109058 | 10 | 49.2 | 0.045712 | 0.085272 | T | Study 1 | CV125 | 315 | 1190 |
| 169 | NC0109866 | 10 | 49.2 | -- | -- | G | Study 1 | -- | 112 | 1191 |
| 170 | NC0112238 | 10 | 51.5 | -- | -- | C | Study 5 | -- | 394 | 1192 |
| 170 | NC0173446 | 10 | 51.6 | 0.028545 | -0.06407 | T | Study 1 | CV082 | 1001 | 1193 |
| 170 | NC0143388 | 10 | 51.6 | 0.024809 | -0.0276 | T | Study 1 | CV072 | 139 | 1194 |
| 170 | NC0143388 | 10 | 52.1 | -- | -- | G | Study 4 | -- | 139 | 1194 |
| 170 | NC0008840 | 10 | 52.1 | -- | -- | G | Study 4 | -- | 109 | 1195 |
| 170 | NC0009350 | 10 | 53 | 0.002196 | 0.054987 | T | Study 1 | CV054 | 176 | 1196 |

CONT.

| QTL | Marker | Chr | pos | sig | effect | res allele | Mapping Study | Fav. Parent | SNP Position | SEQ ID |
|---|---|---|---|---|---|---|---|---|---|---|
| 170 | NC0043776 | 10 | 53 | 0.000066 | -0.02352 | A | Study 1 | CV044 | 74 | 1197 |
| 170 | NC0111673 | 10 | 53 | -- | -- | G | Study 4 | -- | 309 | 1198 |
| 170 | NC0111673 | 10 | 53 | 0.006019 | -0.12385 | G | Study 1 | CV067 | 309 | 1198 |
| 170 | NC0111673 | 10 | 53 | 0.00611 | 0.053924 | G | Study 1 | -- | 309 | 1198 |
| 170 | NC0111673 | 10 | 53 | 0.000422 | -0.16263 | G | Study 1 | CV067 | 309 | 1198 |
| 170 | NC0111673 | 10 | 53 | 0.048729 | 0.176623 | G | Study 1 | CV127 | 309 | 1198 |
| 170 | NC0111673 | 10 | 53 | 0.00581 | -0.11679 | A | Study 1 | CV045 | 309 | 1198 |
| 170 | NC0111673 | 10 | 53 | 0.000008 | 0.02637 | G | Study 1 | -- | 309 | 1198 |
| 170 | NC0111673 | 10 | 53 | 0.033334 | -0.01682 | G | Study 1 | CV041 | 309 | 1198 |
| 170 | NC0009755 | 10 | 54.2 | 7.86E-05 | -0.11882 | G | Study 2 | -- | 301 | 1199 |
| 170 | NC0009755 | 10 | 54.2 | -- | -- | T | Study 4 | -- | 301 | 1199 |
| 170 | NC0002285 | 10 | 55.4 | 0 | 0.154347 | C | Study 1 | CV128 | 313 | 1200 |
| 170 | NC0104512 | 10 | 57.3 | 0 | -0.04054 | A | Study 1 | CV021 | 79 | 1201 |
| 170 | NC0003206 | 10 | 58.6 | -- | -- | T | Study 5 | -- | 255 | 1202 |
| 170 | NC0003206 | 10 | 58.6 | 0.035917 | 0.020828 | T | Study 1 | CV152 | 255 | 1202 |
| 170 | NC0003206 | 10 | 58.6 | 0.040862 | 0.178928 | C | Study 1 | CV132 | 255 | 1202 |
| 170 | NC0003206 | 10 | 58.6 | 0.013859 | 0.070134 | C | Study 1 | CV050 | 255 | 1202 |
| 170 | NC0003206 | 10 | 58.6 | 0.00553 | 0.014062 | C | Study 1 | -- | 255 | 1202 |
| 170 | NC0003206 | 10 | 58.6 | 0.01593 | 0.019689 | T | Study 1 | CV069 | 255 | 1202 |
| 170 | NC0003640 | 10 | 58.9 | 0.004994 | 0.012786 | G | Study 1 | -- | 442 | 1203 |
| 170 | NC0003640 | 10 | 58.9 | 0.000024 | 0.023838 | G | Study 1 | -- | 442 | 1203 |
| 170 | NC0009295 | 10 | 61.3 | 0.016139 | 0.338361 | C | Study 1 | CV167 | 133 | 1204 |
| 170 | NC0009295 | 10 | 61.3 | 0.008475 | 0.024706 | C | Study 1 | CV062 | 133 | 1204 |
| 170 | NC0009295 | 10 | 61.3 | 0 | 0.041387 | C | Study 1 | CV161 | 133 | 1204 |
| 170 | NC0009295 | 10 | 61.3 | 0.036642 | 0.198994 | T | Study 1 | CV130 | 133 | 1204 |
| 170 | NC0109090 | 10 | 61.5 | 0 | -0.04057 | ******** | Study 1 | CV021 | 336 | 1205 |
| 171 | NC0016730 | 10 | 63.8 | 0.016274 | -0.01773 | A | Study 1 | CV039 | 295 | 1206 |
| 171 | NC0016730 | 10 | 63.8 | 0 | 0.149203 | G | Study 1 | CV128 | 295 | 1206 |
| 171 | NC0016730 | 10 | 63.8 | 0.000197 | -0.02209 | A | Study 1 | CV044 | 295 | 1206 |
| 171 | NC0016730 | 10 | 63.8 | 0.038286 | 0.155499 | A | Study 1 | CV163 | 295 | 1206 |
| 171 | NC0016730 | 10 | 63.8 | 0.020295 | 0.011831 | A | Study 1 | -- | 295 | 1206 |
| 171 | NC0016730 | 10 | 63.8 | 0.014176 | -0.01817 | A | Study 1 | CV041 | 295 | 1206 |
| 171 | NC0107941 | 10 | 64.3 | 0.025811 | -0.09519 | A | Study 1 | CV067 | 351 | 1207 |

CONT.

| QTL | Marker | Chr | pos | sig | effect | res allele | Mapping Study | Fav. Parent | SNP Position | SEQ ID |
|---|---|---|---|---|---|---|---|---|---|---|
| 171 | NC0107941 | 10 | 64.3 | 0.003695 | -0.13107 | A | Study 1 | CV067 | 351 | 1207 |
| 171 | NC0112090 | 10 | 64.8 | 0.002772 | 0.059675 | G | Study 1 | -- | 480 | 1208 |
| 171 | NC0173818 | 10 | 65.3 | -- | -- | T | Study 5 | -- | 747 | 1209 |
| 171 | NC0011002 | 10 | 66.5 | 0.000389 | -0.10466 | A | Study 2 | -- | 159 | 1210 |
| 171 | NC0011002 | 10 | 66.5 | -- | -- | C | Study 5 | -- | 159 | 1210 |
| 171 | NC0011002 | 10 | 66.5 | 0.001122 | 0.019282 | A | Study 1 | I283669 | 159 | 1210 |
| 172 | NC0018392 | 10 | 71.5 | 0.036847 | 0.18367 | T | Study 1 | CV127 | 353 | 1211 |
| 172 | NC0018392 | 10 | 71.5 | 0.002086 | 0.224949 | T | Study 1 | CV149 | 353 | 1211 |
| 172 | NC0018392 | 10 | 71.5 | 0.005984 | 0.022022 | T | Study 1 | CV156 | 353 | 1211 |
| 172 | NC0018392 | 10 | 71.5 | 0.000165 | 0.030878 | T | Study 1 | CV161 | 353 | 1211 |
| 172 | NC0018392 | 10 | 71.5 | 0.023295 | -0.0967 | C | Study 1 | CV045 | 353 | 1211 |
| 172 | NC0018392 | 10 | 71.5 | 0.020925 | -0.13661 | C | Study 1 | I294213 | 353 | 1211 |
| 172 | NC0018392 | 10 | 71.5 | 0.000118 | 0.021301 | T | Study 1 | -- | 353 | 1211 |
| 172 | NC0018392 | 10 | 71.5 | 0.00475 | 0.012425 | T | Study 1 | -- | 353 | 1211 |
| 172 | NC0027447 | 10 | 75.6 | -- | -- | G | Study 4 | -- | 311 | 1212 |
| 172 | NC0027447 | 10 | 75.6 | 0.00166 | -0.18528 | C | Study 1 | I294213 | 311 | 1212 |
| 172 | NC0027447 | 10 | 75.6 | 0.001821 | 0.01605 | G | Study 1 | -- | 311 | 1212 |
| 172 | NC0081776 | 10 | 75.8 | -- | -- | T | Study 4 | -- | 136 | 1213 |
| 172 | NC0013745 | 10 | 79 | -- | -- | G | Study 4 | -- | 52 | 1214 |
| 172 | NC0030134 | 10 | 79.4 | 0.021242 | 0.008538 | ******** | Study 1 | CV151 | 94 | 1215 |
| 172 | NC0030134 | 10 | 79.4 | 0.016376 | -0.01718 | ******** | Study 1 | CV072 | 94 | 1215 |
| 172 | NC0030134 | 10 | 79.4 | 0.003321 | 0.014494 | TCCACTAT | Study 1 | -- | 94 | 1215 |
| 173 | NC0011115 | 10 | 90 | 0.028513 | 0.021923 | A | Study 1 | CV152 | 255 | 1216 |
| 173 | NC0011115 | 10 | 90 | 0.000683 | 0.021738 | G | Study 1 | I283669 | 255 | 1216 |
| 173 | NC0011115 | 10 | 90 | 0.029383 | -0.06381 | A | Study 1 | CV082 | 255 | 1216 |
| 173 | NC0011115 | 10 | 90 | 0.023698 | 0.25759 | G | Study 1 | CV124 | 255 | 1216 |
| 173 | NC0011115 | 10 | 90 | 0.009069 | 0.179929 | G | Study 1 | CV149 | 255 | 1216 |
| 173 | NC0011115 | 10 | 90 | 0.021147 | 0.019239 | G | Study 1 | CV161 | 255 | 1216 |
| 173 | NC0011115 | 10 | 90 | 0.038035 | -0.00604 | A | Study 1 | CV115 | 255 | 1216 |
| 173 | NC0070905 | 10 | 92.1 | 0.00763 | -0.08478 | G | Study 2 | -- | 100 | 1217 |
| 173 | NC0070905 | 10 | 92.1 | 0.02693 | 0.212149 | G | Study 1 | CV130 | 100 | 1217 |
| 173 | NC0067173 | 10 | 98 | <.0001 | -0.20298 | G | Study 3 | -- | 344 | 1218 |
| 173 | NC0067173 | 10 | 98 | 0.009913 | 0.04922 | G | Study 1 | -- | 344 | 1218 |

CONT.

| QTL | Marker | Chr | pos | sig | effect | res allele | Mapping Study | Fav. Parent | SNP Position | SEQ ID |
|---|---|---|---|---|---|---|---|---|---|---|
| 173 | NC0067173 | 10 | 98 | 0.006206 | -0.0166 | T | Study 1 | CV044 | 344 | 1218 |
| 173 | NC0067173 | 10 | 98 | 0.005596 | 0.003947 | T | Study 1 | CV016 | 344 | 1218 |
| 173 | NC0067173 | 10 | 98 | 0.005596 | 0.003947 | T | Study 1 | CV016 | 344 | 1218 |
| 173 | NC0199588 | 10 | 99.9 | -- | -- | G | Study 5 | -- | 137 | 1219 |
| 174 | NC0154948 | 10 | 102.2 | 0.009826 | -0.01817 | ** | Study 1 | CV021 | 234 | 1220 |
| 174 | NC0154948 | 10 | 102.2 | 0.022216 | 0.012246 | ** | Study 1 | -- | 234 | 1220 |
| 174 | NC0009486 | 10 | 105.5 | -- | -- | T | Study 4 | -- | 225 | 1221 |
| 174 | NC0009486 | 10 | 105.5 | 0.018159 | 0.10096 | T | Study 1 | CV125 | 225 | 1221 |
| 174 | NC0009486 | 10 | 105.5 | 0.01377 | 0.103638 | T | Study 1 | CV166 | 225 | 1221 |
| 174 | NC0009486 | 10 | 105.5 | 0.040711 | 0.229851 | T | Study 1 | CV124 | 225 | 1221 |
| 174 | NC0009486 | 10 | 105.5 | 0.028 | 0.025059 | A | Study 1 | CV154 | 225 | 1221 |
| 175 | NC0008954 | 10 | 112 | 0.01365 | 0.201778 | C | Study 1 | CV130 | 345 | 1222 |
| 175 | NC0008954 | 10 | 112 | 0.016656 | 0.013513 | T | Study 1 | CV159 | 345 | 1222 |
| 175 | NC0008954 | 10 | 112 | 0.045066 | 0.01331 | T | Study 1 | CV014 | 345 | 1222 |
| 175 | NC0107333 | 10 | 113.1 | -- | -- | T | Study 4 | -- | 174 | 1223 |
| 175 | NC0107333 | 10 | 113.1 | 0.039133 | 0.020108 | C | Study 1 | CV152 | 174 | 1223 |
| 175 | NC0107333 | 10 | 113.1 | 0.032419 | -0.01396 | T | Study 1 | CV047 | 174 | 1223 |
| 175 | NC0109666 | 10 | 113.1 | 0.027106 | 0.012937 | G | Study 1 | CV159 | 75 | 1224 |
| 175 | NC0151488 | 10 | 114.6 | 0.031284 | 0.078602 | T | Study 1 | CV079 | 202 | 1225 |
| 175 | NC0151488 | 10 | 114.6 | 0.008 | 0.108134 | T | Study 1 | CV079 | 202 | 1225 |
| 175 | NC0008643 | 10 | 119.1 | -- | -- | G | Study 4 | -- | 281 | 1226 |
| 175 | NC0008643 | 10 | 119.1 | 0.049834 | 0.178784 | A | Study 1 | CV109 | 281 | 1226 |
| 175 | NC0008643 | 10 | 119.1 | 0.046602 | 0.082561 | G | Study 1 | CV093 | 281 | 1226 |
| 175 | NC0008643 | 10 | 119.1 | 0.00478 | 0.12034 | G | Study 1 | CV125 | 281 | 1226 |
| 175 | NC0008643 | 10 | 119.1 | 0.038793 | -0.10742 | A | Study 1 | CV112 | 281 | 1226 |
| 175 | NC0008643 | 10 | 119.1 | 0.049885 | -0.10595 | A | Study 1 | CV119 | 281 | 1226 |
| 175 | NC0008643 | 10 | 119.1 | 0.012644 | 0.01204 | G | Study 1 | CV069 | 281 | 1226 |
| 175 | NC0008643 | 10 | 119.1 | 0.031391 | 0.006145 | A | Study 1 | CV109 | 281 | 1226 |
| 176 | NC0111488 | 10 | 123.3 | 0.008636 | -0.01341 | A | Study 1 | CV136 | 258 | 1227 |

CONT.

METHODS AND COMPOSITIONS FOR GRAY LEAF SPOT RESISTANCE IN CORN

CROSS-REFERENCE TO RELATED APPLICATIONS

This application claims priority to U.S. Provisional Patent Application No. 60/966,706, filed Aug. 29, 2007 and incorporated herein by reference in its' entirety.

INCORPORATION OF SEQUENCE LISTING

A sequence listing is contained in the file named "46_25 (54886_002_US).txt" which is 2432213 bytes (measured in MS-Windows) and was created on Aug. 20, 2008 and comprising 1,361 nucleotide sequences and is electronically filed herewith and is incorporated herein by reference.

FIELD OF INVENTION

The present invention relates to the field of plant breeding. More specifically, the present invention includes a method of using haploid plants for genetic mapping of traits such as disease resistance. Further, the invention includes a method for breeding corn plants containing quantitative trait loci (QTL) that are associated with resistance to gray leaf spot, a fungal disease associated with *Cercospora* spp.

BACKGROUND OF INVENTION

The present invention provides methods and compositions for introgressing disease resistance loci in corn. GLS is a global problem and, in addition to prevalence in Africa, Central America and South America, it has spread across most of the U.S. Corn Belt over the past 10-15 years. The fungus overwinters in field debris and requires moisture, usually in the form of heavy fogs, dews, or rains, to spread its spores and infect corn. Increasing pervasiveness has been linked to no-till practices which promote retention of fungi, such as *Cercospora zea* (CZ), in the soil (Paul et al., *Phytopathology* 95:388-396 (2005)). Symptoms include a rectangular necrotic lesion which can coalesce to larger affected regions and symptoms usually appear later in the growing season. GLS in corn elicits an increased allocation of plant resources to damaged leaf tissue, leading to elevated risk for root and stalk rots, which ultimately results in even greater crop losses (Ward et al., 1999; Saghai-Maroof et al, *Theor. Appl. Genet.* 93:539-546 (1996)). Yield-loss associated with GLS can be high if the symptoms are heavy and appear early, with reported losses exceeding 50% (Ward et al., 1999). Recent work has identified there are at least two sister species of CZ, as well as potentially other isolates of Cercospora, capable of causing GLS (Carson et al., *Maydica* 51:89-92 (2006); Carson et al, *Plant Dis.* 86:1088-109 (2002)). Genomic regions on maize Chromosomes 1, 2, 3, 4, 5, 6, 7, and 8 have been associated with GLS using RFLP, AFLP and SSR markers (U.S. Pat. No. 5,574,210; Lehmensiek, et al., TAG, (2001); Clements, et al. *Phytopathology* (2000); Gorden et al. *Crop Science* (2004); Bubeck, et al., *Crop Science*, (1993); Saghai-Maroof et al., *Theor. Appl. Genet* (1996)). Certain genomic regions, molecular markers, and QTL associated with GLS resistance have also been reported (WO 2008/042185 A2).

Breeding for corn plants resistant to GLS can be greatly facilitated by the use of marker-assisted selection. Of the classes of genetic markers, single nucleotide polymorphisms (SNPs) have characteristics which make them preferential to other genetic markers in detecting, selecting for, and introgressing disease resistance in a corn plant. SNPs are preferred because technologies are available for automated, high-throughput screening of SNP markers, which can decrease the time to select for and introgress disease resistance in corn plants. Further, SNP markers are ideal because the likelihood that a particular SNP allele is derived from independent origins in the extant population of a particular species is very low. As such, SNP markers are useful for tracking and assisting introgression of disease resistance alleles, particularly in the case of disease resistance haplotypes.

SUMMARY OF THE INVENTION

Various methods and compositions for identifying and obtaining corn plants with resistance to Gray Leaf Spot (GLS) are provided herein. In certain embodiments, a method of identifying a corn plant comprising at least one allele associated with Gray Leaf Spot (GLS) resistance allele in a corn plant comprising: a) genotyping at least one corn plant with at least one nucleic acid marker selected from the group consisting of SEQ ID NOs:1-62, 64-70, 72-156, 158-172, 174-187, 189-377, 379, 380, 382-409, 411-459, 461-1233, 1360 and 1361, and b) selecting at least one corn plant comprising an allele of at least one of said markers associated with Gray Leaf Spot (GLS) resistance is provided. In certain embodiments of the methods, at least one corn plant genotyped in step (a) and/or the at least one corn plant selected in step (b) is a corn plant from a population generated by a cross. In embodiments where the population is generated by a cross, the cross can be effected by mechanical emasculation, chemical sterilization, or genetic sterilization of a pollen acceptor. In certain embodiments of the methods, genotyping is effected in step (a) by determining the allelic state of at least one of said corn genomic DNA markers. In certain embodiments of the methods, the selected one or more corn plants can exhibit at least partial resistance to a GLS-inducing fungus or at least substantial resistance to a GLS-inducing fungus. In certain embodiments of the methods, the population can be generated by a cross of at least one Gray Leaf Spot (GLS) resistant corn plant with at least one Gray Leaf Spot (GLS) sensitive corn plant. In certain embodiments of the methods, the population can be a segregating population or a haploid breeding population. In certain embodiments of the methods, the cross can be a back cross of at least one Gray Leaf Spot (GLS) resistant corn plant with at least one Gray Leaf Spot (GLS) sensitive corn plant to introgress GLS resistance into a corn germplasm.

Also provided herein are corn plants obtained by any of the aforementioned methods of identifying corn plants that comprise alleles of genetic loci associated with Gray Leaf Spot resistance. In certain embodiments, a corn plant obtained by any of these aforementioned methods can comprise at least one allele of a nucleic acid marker selected from the group consisting of SEQ ID NOs: 1-62, 64-70, 72-156, 158-172, 174-187, 189-377, 379, 380, 382-409, 411-459, 461-1233 and SEQ ID NOs: 1360 and 1361, wherein said allele is associated with Gray Leaf Spot (GLS) resistance. In certain embodiments, a corn plant obtained by any of these aforementioned methods can exhibit at least partial resistance to a GLS-inducing fungus or at least substantial resistance to a GLS-inducing fungus. In certain embodiments, a corn plant obtained by any of these aforementioned methods can be a haploid corn plant. In certain embodiments, a corn plant obtained by any of the aforementioned methods and comprising at least one of the alleles can comprise at least one transgenic trait. In such embodiments, the transgenic trait can be herbicide tolerance and/or pest resistance. In embodiments where the corn plant obtained is herbicide tolerant, herbicide tolerance can be selected from the group consisting of glyphosate, dicamba, glufosinate, sulfonylurea, bromoxynil and norflurazon herbicide tolerance.

In certain embodiments, methods of introgressing a Gray Leaf Spot (GLS) resistance QTL allele into a corn plant comprising: a) screening a population with at least one nucleic acid marker to determine if one or more corn plants from the population comprise(s) an allele of said marker associated with a Gray Leaf Spot (GLS) resistance QTL selected from the group consisting of QTL numbers 1-9, 14-33, 35, 38-42, 44-52, 54-61, 63-71, 73-79, 81-92, 95-96, 99-106, 108-117, and 119-178 as provided in FIG. 1; and b) selecting from said population at least one corn plant comprising an allele of said marker associated with a Gray Leaf Spot (GLS) resistance are provided. In certain embodiments of the methods, at least one of the markers can be located within 5 cM, 2 cM, or 1 cM of at least one of the Gray Leaf Spot (GLS) resistance QTL. In certain embodiments of the methods, at least one of the markers can exhibit a LOD score of greater than 4.0 with at least one of said Gray Leaf Spot (GLS) resistance QTL. In certain embodiments of the methods, the population can be generated by a cross of at least one Gray Leaf Spot (GLS) resistant corn plant with at least one Gray Leaf Spot (GLS) sensitive corn plant. In certain embodiments of the methods, the population can be a haploid breeding population. In certain embodiments of the methods, the nucleic acid marker is selected from the group consisting of SEQ ID NOs: 858, 860, 862, 866, 875, 877, 881, 882, 883, and 1360.

Also provided herein are corn plants obtained by any of the aforementioned methods of identifying corn plants that comprise a Gray Leaf Spot resistance QTL. In certain embodiments, a corn plant obtained by any of these aforementioned methods can comprise a Gray Leaf Spot (GLS) resistance QTL selected from the group consisting of QTL numbers 1-9, 14-33, 35, 38-42, 44-52, 54-61, 63-71, 73-79, 81-92, 95-96, 99-106, 108-117, and 119-178 as provided in FIG. 1. In certain embodiments, a corn plant obtained by any of these aforementioned methods can exhibit at least partial resistance to a GLS-inducing fungus or at least substantial resistance to a GLS-inducing fungus. In certain embodiments, a corn plant obtained by any of these aforementioned methods can be a haploid corn plant. In certain embodiments, a corn plant obtained by any of the aforementioned methods and comprising at least one of the QTL can comprise at least one transgenic trait. In such embodiments, the transgenic trait can be herbicide tolerance and/or pest resistance. In embodiments where the corn plant obtained is herbicide tolerant, herbicide tolerance can be selected from the group consisting of glyphosate, dicamba, glufosinate, sulfonylurea, bromoxynil and norflurazon herbicide tolerance.

Also provided herein are isolated nucleic acid markers for identifying polymorphisms in corn DNA. These isolated nucleic acids can be used in a variety of applications, including but not limited to, the identification of corn plants that comprise alleles of genetic loci associated with Gray Leaf Spot resistance. In certain embodiments, an isolated nucleic acid molecule for detecting a molecular marker representing a polymorphism in corn DNA, wherein the nucleic acid molecule comprises at least 15 nucleotides that include or are immediately adjacent to said polymorphism, wherein said nucleic acid molecule is at least 90 percent identical to a sequence of the same number of consecutive nucleotides in either strand of DNA that include or are immediately adjacent to said polymorphism, and wherein said molecular marker is selected from the group consisting of SEQ ID NOs: 1-26, 28-62, 64-70, 72-120, 122-140, 142-156, 158-172, 174, 176, 178-187, 189-219, 221-223, 225-233, 235-247, 249-251, 253-377, 379, 380, 382-409, 411-439, 441-459, 461-478, 481-532, 534-581, 583-584, 586-638, 640-720, 722-726, 728-732, 734-745, 747-767, 769-772, 774-939, 941-1052, 1055-1121, 1123-1185, 1187-1233, 1304 through SEQ ID NO: 1331, 1360, and 1361. In certain embodiments, the molecular marker is selected from the group consisting of SEQ ID NOs: 858, 860, 862, 866, 875, 877, 881, 882, 883, and 1360. In certain embodiments, the isolated nucleic acid further comprises a detectable label or provides for incorporation of a detectable label. In such embodiments that comprise or provide for incorporation of a detectable label, the detectable label is selected from the group consisting of an isotope, a fluorophore, an oxidant, a reductant, a nucleotide and a hapten. In certain embodiments, the detectable label is added to the nucleic acid by a chemical reaction or is incorporated by an enzymatic reaction. In certain embodiments, the isolated nucleic acid molecule comprises at least 16 or 17 nucleotides that include or are immediately adjacent to the polymorphism. In other embodiments, the nucleic acid molecule comprises at least 18 nucleotides that include or are immediately adjacent to the polymorphism or comprises at least 20 nucleotides that include or are immediately adjacent to the polymorphism. In certain embodiments, the isolated nucleic acid molecule hybridizes to at least one allele of the molecular marker under stringent hybridization conditions.

BRIEF DESCRIPTION OF THE DRAWINGS

The accompanying drawings, which are incorporated in and form a part of the specification, illustrate the embodiments of the present invention and together with the description, serve to explain the principles of the invention.

In the drawings:

FIG. 1 shows markers associated with GLS resistance from association mapping studies.

"*" indicates a single nucleotide deletion.

DETAILED DESCRIPTION OF THE INVENTION

Definitions

The definitions and methods provided herein define the present invention and guide those of ordinary skill in the art in the practice of the present invention. Unless otherwise noted, terms are to be understood according to conventional usage by those of ordinary skill in the relevant art. Definitions of common terms in molecular biology may also be found in Alberts et al., Molecular Biology of The Cell, $3^{rd}$ Edition, Garland Publishing, Inc.: New York, 1994; Rieger et al., Glossary of Genetics: Classical and Molecular, 5th Edition, Springer-Verlag: New York, 1991; and Lewin, Genes V, Oxford University Press New York, 1994. The nomenclature for DNA bases as set forth at 37 CFR §1.822 is used.

As used herein, a "locus" is a fixed position on a chromosome and may represent a single nucleotide, a few nucleotides or a large number of nucleotides in a genomic region.

As used herein, "polymorphism" means the presence of one or more variations of a nucleic acid sequence at one or more loci in a population of one or more individuals. The variation may comprise but is not limited to, one or more base changes, the insertion of one or more nucleotides or the deletion of one or more nucleotides. A polymorphism includes a single nucleotide polymorphism (SNP), a simple sequence repeat (SSR) and indels, which are insertions and deletions. A polymorphism may arise from random processes in nucleic acid replication, through mutagenesis, as a result of mobile genomic elements, from copy number variation and during the process of meiosis, such as unequal crossing over, genome duplication and chromosome breaks and fusions. The variation can be commonly found or may exist at low frequency within a population, the former having greater utility in general plant breeding and the later may be associated with rare but important phenotypic variation.

As used herein, "marker" means a detectable characteristic that can be used to discriminate between organisms. Examples of such characteristics may include genetic markers, protein composition, protein levels, oil composition, oil levels, carbohydrate composition, carbohydrate levels, fatty acid composition, fatty acid levels, amino acid composition, amino acid levels, biopolymers, pharmaceuticals, starch composition, starch levels, fermentable starch, fermentation yield, fermentation efficiency, energy yield, secondary compounds, metabolites, morphological characteristics, and agronomic characteristics.

As used herein, "genetic marker" means polymorphic nucleic acid sequence or nucleic acid feature. A "polymorphism" is a variation among individuals in sequence, particularly in DNA sequence, or feature, such as a transcriptional profile or methylation pattern. Useful polymorphisms include single nucleotide polymorphisms (SNPs), insertions or deletions in DNA sequence (Indels), simple sequence repeats of DNA sequence (SSRs) a restriction fragment length polymorphism, a haplotype, and a tag SNP. A genetic marker, a gene, a DNA-derived sequence, a RNA-derived sequence, a promoter, a 5' untranslated region of a gene, a 3' untranslated region of a gene, microRNA, siRNA, a QTL, a satellite marker, a transgene, mRNA, ds mRNA, a transcriptional profile, and a methylation pattern may comprise polymorphisms.

As used herein, "marker assay" means a method for detecting a polymorphism at a particular locus using a particular method, e.g. measurement of at least one phenotype (such as seed color, flower color, or other visually detectable trait), restriction fragment length polymorphism (RFLP), single base extension, electrophoresis, sequence alignment, allelic specific oligonucleotide hybridization (ASO), random amplified polymorphic DNA (RAPD), microarray-based technologies, and nucleic acid sequencing technologies, etc.

As used herein, the phrase "immediately adjacent", when used to describe a nucleic acid molecule that hybridizes to DNA containing a polymorphism, refers to a nucleic acid that hybridizes to DNA sequences that directly abut the polymorphic nucleotide base position. For example, a nucleic acid molecule that can be used in a single base extension assay is "immediately adjacent" to the polymorphism.

As used herein, "interrogation position" refers to a physical position on a solid support that can be queried to obtain genotyping data for one or more predetermined genomic polymorphisms.

As used herein, "consensus sequence" refers to a constructed DNA sequence which identifies SNP and Indel polymorphisms in alleles at a locus. Consensus sequence can be based on either strand of DNA at the locus and states the nucleotide base of either one of each SNP in the locus and the nucleotide bases of all Indels in the locus. Thus, although a consensus sequence may not be a copy of an actual DNA sequence, a consensus sequence is useful for precisely designing primers and probes for actual polymorphisms in the locus.

As used herein, the term "single nucleotide polymorphism," also referred to by the abbreviation "SNP," means a polymorphism at a single site wherein said polymorphism constitutes a single base pair change, an insertion of one or more base pairs, or a deletion of one or more base pairs.

As used herein, "genotype" means the genetic component of the phenotype and it can be indirectly characterized using markers or directly characterized by nucleic acid sequencing. Suitable markers include a phenotypic character, a metabolic profile, a genetic marker, or some other type of marker. A genotype may constitute an allele for at least one genetic marker locus or a haplotype for at least one haplotype window. In some embodiments, a genotype may represent a single locus and in others it may represent a genome-wide set of loci. In another embodiment, the genotype can reflect the sequence of a portion of a chromosome, an entire chromosome, a portion of the genome, and the entire genome.

As used herein, the term "haplotype" means a chromosomal region within a haplotype window defined by at least one polymorphic molecular marker. The unique marker fingerprint combinations in each haplotype window define individual haplotypes for that window. Further, changes in a haplotype, brought about by recombination for example, may result in the modification of a haplotype so that it comprises only a portion of the original (parental) haplotype operably linked to the trait, for example, via physical linkage to a gene, QTL, or transgene. Any such change in a haplotype would be included in our definition of what constitutes a haplotype so long as the functional integrity of that genomic region is unchanged or improved.

As used herein, the term "haplotype window" means a chromosomal region that is established by statistical analyses known to those of skill in the art and is in linkage disequilibrium. Thus, identity by state between two inbred individuals (or two gametes) at one or more molecular marker loci located within this region is taken as evidence of identity-by-descent of the entire region. Each haplotype window includes at least one polymorphic molecular marker. Haplotype windows can be mapped along each chromosome in the genome. Haplotype windows are not fixed per se and, given the ever-increasing density of molecular markers, this invention anticipates the number and size of haplotype windows to evolve, with the number of windows increasing and their respective sizes decreasing, thus resulting in an ever-increasing degree confidence in ascertaining identity by descent based on the identity by state at the marker loci.

As used herein, a plant referred to as "haploid" has a single set (genome) of chromosomes and the reduced number of chromosomes (n) in the haploid plant is equal to that of the gamete.

As used herein, a plant referred to as "doubled haploid" is developed by doubling the haploid set of chromosomes. A plant or seed that is obtained from a doubled haploid plant that is selfed any number of generations may still be identified as a doubled haploid plant. A doubled haploid plant is considered a homozygous plant. A plant is considered to be doubled haploid if it is fertile, even if the entire vegetative part of the plant does not consist of the cells with the doubled set of chromosomes; that is, a plant will be considered doubled haploid if it contains viable gametes, even if it is chimeric.

As used herein, a plant referred to as "diploid" has two sets (genomes) of chromosomes and the chromosome number (2n) is equal to that of the zygote.

As used herein, the term "plant" includes whole plants, plant organs (i.e., leaves, stems, roots, etc.), seeds, and plant cells and progeny of the same. "Plant cell" includes without limitation seeds, suspension cultures, embryos, meristematic regions, callus tissue, leaves, shoots, gametophytes, sporophytes, pollen, and microspores.

As used herein, a "genetic map" is the ordered list of loci known for a particular genome.

As used herein, "phenotype" means the detectable characteristics of a cell or organism which are a manifestation of gene expression.

As used herein, a "phenotypic marker" refers to a marker that can be used to discriminate phenotypes displayed by organisms.

As used herein, "linkage" refers to relative frequency at which types of gametes are produced in a cross. For example, if locus A has genes "A" or "a" and locus B has genes "B" or "b" and a cross between parent I with AABB and parent B with aabb will produce four possible gametes where the genes are segregated into AB, Ab, aB and ab. The null expectation is that there will be independent equal segregation into each of the four possible genotypes, i.e. with no linkage ¼ of the gametes will of each genotype. Segregation of gametes into a genotypes differing from ¼ are attributed to linkage.

As used herein, "linkage disequilibrium" is defined in the context of the relative frequency of gamete types in a population of many individuals in a single generation. If the frequency of allele A is p, a is p', B is q and b is q', then the expected frequency (with no linkage disequilibrium) of genotype AB is pq, Ab is pq', aB is p'q and ab is p'q'. Any deviation from the expected frequency is called linkage disequilibrium. Two loci are said to be "genetically linked" when they are in linkage disequilibrium.

As used herein, "quantitative trait locus (QTL)" means a locus that controls to some degree numerically representable traits that are usually continuously distributed.

As used herein, the term "transgene" means nucleic acid molecules in form of DNA, such as cDNA or genomic DNA, and RNA, such as mRNA or microRNA, which may be single or double stranded.

As used herein, the term "inbred" means a line that has been bred for genetic homogeneity.

As used herein, the term "hybrid" means a progeny of mating between at least two genetically dissimilar parents. Without limitation, examples of mating schemes include single crosses, modified single cross, double modified single cross, three-way cross, modified three-way cross, and double cross wherein at least one parent in a modified cross is the progeny of a cross between sister lines.

As used herein, the term "tester" means a line used in a testcross with another line wherein the tester and the lines tested are from different germplasm pools. A tester may be isogenic or nonisogenic.

As used herein, "resistance allele" means the isolated nucleic acid sequence that includes the polymorphic allele associated with resistance to the disease or condition of concern.

As used herein, the term "corn" means *Zea mays* or maize and includes all plant varieties that can be bred with corn, including wild maize species.

As used herein, the term "comprising" means "including but not limited to".

As used herein, an "elite line" is any line that has resulted from breeding and selection for superior agronomic performance.

As used herein, an "inducer" is a line which when crossed with another line promotes the formation of haploid embryos.

As used herein, "haplotype effect estimate" means a predicted effect estimate for a haplotype reflecting association with one or more phenotypic traits, wherein the associations can be made de novo or by leveraging historical haplotype-trait association data.

As used herein, "breeding value" means a calculation based on nucleic acid sequence effect estimates and nucleic acid sequence frequency values, the breeding value of a specific nucleic acid sequence relative to other nucleic acid sequences at the same locus (i.e., haplotype window), or across loci (i.e., haplotype windows), can also be determined. In other words, the change in population mean by fixing said nucleic acid sequence is determined. In addition, in the context of evaluating the effect of substituting a specific region in the genome, either by introgression or a transgenic event, breeding values provide the basis for comparing specific nucleic acid sequences for substitution effects. Also, in hybrid crops, the breeding value of nucleic acid sequences can be calculated in the context of the nucleic acid sequence in the tester used to produce the hybrid.

To the extent to which any of the preceding definitions is inconsistent with definitions provided in any patent or non-patent reference incorporated herein or in any reference found elsewhere, it is understood that the preceding definition will be used herein.

Methods and Compositions for Gray Leaf Spot Resistance in Corn

The present invention provides a method of using haploid plants to identify genotypes associated with phenotypes of interest wherein the haploid plant is assayed with at least one marker and associating the at least one marker with at least one phenotypic trait. The genotype of interest can then be used to make decisions in a plant breeding program. Such decisions include, but are not limited to, selecting among new breeding populations which population has the highest frequency of favorable nucleic acid sequences based on historical genotype and agronomic trait associations, selecting favorable nucleic acid sequences among progeny in breeding populations, selecting among parental lines based on prediction of progeny performance, and advancing lines in germplasm improvement activities based on presence of favorable nucleic acid sequences. Non-limiting examples of germplasm improvement activities include line development, hybrid development, transgenic event selection, making breeding crosses, testing and advancing a plant through self fertilization, using plants for transformation, using plants for candidates for expression constructs, and using plants for mutagenesis.

Non-limiting examples of breeding decisions include progeny selection, parent selection, and recurrent selection for at least one haplotype. In another aspect, breeding decisions relating to development of plants for commercial release comprise advancing plants for testing, advancing plants for purity, purification of sublines during development, inbred development, variety development, and hybrid development. In yet other aspects, breeding decisions and germplasm improvement activities comprise transgenic event selection, making breeding crosses, testing and advancing a plant through self-fertilization, using plants for transformation, using plants for candidates for expression constructs, and using plants for mutagenesis.

In still another embodiment, the present invention acknowledges that preferred haplotypes and QTL identified by the methods presented herein may be advanced as candidate genes for inclusion in expression constructs, i.e., transgenes. Nucleic acids underlying haplotypes or QTL of interest may be expressed in plant cells by operably linking them to a promoter functional in plants. In another aspect, nucleic acids underlying haplotypes or QTL of interest may have their expression modified by double-stranded RNA-mediated gene suppression, also known as RNA interference ("RNAi"), which includes suppression mediated by small interfering RNAs ("siRNA"), trans-acting small interfering RNAs ("ta-siRNA"), or microRNAs ("miRNA"). Examples of RNAi methodology suitable for use in plants are described in detail in U.S. Patent Application Publications 2006/0200878 and 2007/0011775.

Methods are known in the art for assembling and introducing constructs into a cell in such a manner that the nucleic acid molecule for a trait is transcribed into a functional mRNA molecule that is translated and expressed as a protein product. For the practice of the present invention, conventional compositions and methods for preparing and using constructs and host cells are well known to one skilled in the art, see for example, Molecular Cloning: A Laboratory Manual, 3rd Edition Volumes 1, 2, and 3 (2000) J. F. Sambrook, D. W. Russell, and N. Irwin, Cold Spring Harbor Laboratory Press. Methods for making transformation constructs particularly suited to plant transformation include, without limitation, those described in U.S. Pat. Nos. 4,971,908, 4,940,835, 4,769,061 and 4,757,011, all of which are herein incorporated by reference in their entirety. Transformation methods for the introduction of expression units into plants are known in the art and include electroporation as illustrated in U.S. Pat. No. 5,384,253; microprojectile bombardment as illustrated in U.S. Pat. Nos. 5,015,580; 5,550,318; 5,538,880; 6,160,208; 6,399,861; and 6,403,865; protoplast transformation as illustrated in U.S. Pat. No. 5,508,184; and Agrobacterium-mediated transformation as illustrated in U.S. Pat. Nos. 5,635,055; 5,824,877; 5,591,616; 5,981,840; and 6,384,301.

Gray Leaf Spot Resistance

The present invention provides GLS resistance loci that are located in public bins in the maize genome that were not previously associated with GLS resistance.

The present invention provides 160 GLS resistance loci that are located in public bins in the maize genome that were not previously associated with GLS resistance. QTL were assigned by dividing maize chromosomal regions into 10 cM windows. A total of 178 QTL associated with GLS were identified, of which 158 have not been previously reported. SNP markers are also provided for monitoring the introgression of the 178 GLS resistance QTL.

In the present invention, GLS resistant loci 1-9, 14-33, 35, 38-42, 44-52, 54-61, 63-71, 73-79, 81-92, 95-96, 99-106, 108-117, and 119-178 have not been previously associated with GLS and are provided. SNP markers are also provided for monitoring the introgression of GLS resistance. In the present invention, GLS resistance loci 1, 2, 3, 4, 5, 6, 7, 8, 9, 10, 11, 12, 13, 14, 15, 16, 17, 18, 19, 20, 21, 22, 23, 24, 25, 26, and 177 are located on chromosome 1. SNP markers used to monitor the introgression of GLS resistance locus 1 include those selected from the group consisting of SEQ ID NOs: 1 through 9. SNP markers used to monitor the introgression of GLS resistance locus 2 include those selected from the group consisting of SEQ ID NOs: 10 through 14. SNP markers used to monitor the introgression of GLS resistance locus 3 include those selected from the group consisting of SEQ ID NOs: 15 through 22. SNP markers used to monitor the introgression of GLS resistance locus 4 include those selected from the group consisting of SEQ ID NOs: 23 through 30. SNP markers used to monitor the introgression of GLS resistance locus 5 include those selected from the group consisting of SEQ ID NOs: 31 through 37. SNP markers used to monitor the introgression of GLS resistance locus 6 include those selected from the group consisting of SEQ ID NOs: 38 through 48. SNP markers used to monitor the introgression of GLS resistance locus 7 include those selected from the group consisting of SEQ ID NOs: 49 through 58. SNP markers used to monitor the introgression of GLS resistance locus 8 include those selected from the group consisting of SEQ ID NOs: 59 through 73. SNP markers used to monitor the introgression of GLS resistance locus 9 include those selected from the group consisting of SEQ ID NOs: 74 through 86. SNP markers used to monitor the introgression of GLS resistance locus 10 include those selected from the group consisting of SEQ ID NOs: 87 through 93. SNP markers used to monitor the introgression of GLS resistance locus 11 include those selected from the group consisting of SEQ ID NOs: 94 through 115. SNP markers used to monitor the introgression of GLS resistance locus 12 include those selected from the group consisting of SEQ ID NOs: 116 through 126. SNP markers used to monitor the introgression of GLS resistance locus 13 include those selected from the group consisting of SEQ ID NOs: 127 through 135. SNP markers used to monitor the introgression of GLS resistance locus 14 include those selected from the group consisting of SEQ ID NOs: 136 through 139. SNP markers used to monitor the introgression of GLS resistance locus 15 include those selected from the group consisting of SEQ ID NOs: 140 through 144. SNP markers used to monitor the introgression of GLS resistance locus 16 include those selected from the group consisting of SEQ ID NOs: 145 through 151. SNP markers used to monitor the introgression of GLS resistance locus 17 include those selected from the group consisting of SEQ ID NOs: 152 through 162. SNP markers used to monitor the introgression of GLS resistance locus 18 include those selected from the group consisting of SEQ ID NOs: 163 through 172. SNP markers used to monitor the introgression of GLS resistance locus 19 include those selected from the group consisting of SEQ ID NOs: 173 through 178. SNP markers used to monitor the introgression of GLS resistance locus 20 include those selected from the group consisting of SEQ ID NOs: 179 through 183. SNP markers used to monitor the introgression of GLS resistance locus 20 include those selected from the group consisting of SEQ ID NOs: 179 through 183. SNP markers used to monitor the introgression of GLS resistance locus 21 include those selected from the group consisting of SEQ ID NOs: 184 through 197. SNP markers used to monitor the introgression of GLS resistance locus 22 include those selected from the group consisting of SEQ ID NOs: 198 through 199. SNP markers used to monitor the introgression of GLS resistance locus 23 include those selected from the group consisting of SEQ ID NOs: 200 through 201. SNP markers used to monitor the introgression of GLS resistance locus 24 include those selected from the group consisting of SEQ ID NOs: 202 through 206. SNP markers used to monitor the introgression of GLS resistance locus 25 include those selected from the group consisting of SEQ ID NOs: 207 through 208. SNP markers used to monitor the introgression of GLS resistance locus 26 include those selected from the group consisting of SEQ ID NOs: 209 through 211. SNP markers used to monitor the introgression of GLS resistance locus 177 include SEQ ID NO: 1228.

In the present invention GLS resistant loci 27, 28, 29, 30, 31, 32, 33, 34, 35, 36, 37, 38, 39, 40, 41, 42, 43, 44, 45, 46, and 178 are located on Chromosome 2. SNP markers used to monitor the introgression of GLS resistance locus 27 include those selected from the group consisting of SEQ ID NOs: 212 through 215. SNP markers used to monitor the introgression of GLS resistance locus 28 include those selected from the group consisting of SEQ ID NOs: 216 through 221 and 1229. SNP markers used to monitor the introgression of GLS resistance locus 29 include those selected from the group consisting of SEQ ID NOs: 222 through 224. SNP markers used to monitor the introgression of GLS resistance locus 30 include those selected from the group consisting of SEQ ID NOs: 225 through 231. SNP markers used to monitor the introgression of GLS resistance locus 31 include those selected from the group consisting of SEQ ID NOs: 232 through 236. SNP markers used to monitor the introgression of GLS resistance locus 32 include those selected from the group consisting of SEQ ID NOs: 237 through 242. SNP markers used to monitor the introgression of GLS resistance locus 33 include those selected from the group consisting of SEQ ID NOs: 244 through 248. SNP markers used to monitor the introgression of GLS resistance locus 34 include those selected from the group consisting of SEQ ID NOs: 249 through 260. SNP markers used to monitor the introgression of GLS resistance locus 35 include those selected from the group consisting of SEQ ID NOs: 261 through 269. SNP markers used to monitor the introgression of GLS resistance locus 36 include those selected from the group consisting of SEQ ID NOs: 270 through 291. SNP markers used to monitor the introgression of GLS resistance locus 37 include those selected from the group consisting of SEQ ID NOs: 292 through 303. SNP markers used to monitor the introgression of GLS resistance locus 38 include those selected from the group consisting of SEQ ID NOs: 304 through 311. SNP markers used to monitor the introgression of GLS resistance locus 39 include those selected from the group consisting of SEQ ID NOs: 312 through 321. SNP markers used to monitor the introgression of GLS resistance locus 40 include those selected from the group consisting of SEQ ID NOs: 322 through 330. SNP markers used to monitor the introgression of GLS resistance locus 41 include those selected from the group consisting of SEQ ID NOs: 331 through 335. SNP markers used to monitor the introgression of GLS resistance locus 42 include those selected from the group consisting of SEQ ID NOs: 336 through 341. SNP markers used to monitor the introgression of GLS resistance locus 43 include those selected from the group consisting of SEQ ID NOs: 342 through 348. SNP markers used to monitor the introgression of GLS resistance locus 44 include those selected from the group consisting of SEQ ID NOs: 349 through 351. SNP markers used to monitor the introgression of GLS resistance locus 45 include those selected from the group consisting of SEQ ID NOs: 352 through 355. SNP markers used to monitor the introgression of GLS resistance locus 46 include those selected from the group consisting of SEQ ID NOs: 356 through 360. SNP markers used to monitor the introgression of GLS resistance locus 178 include SEQ ID NO: 1229.

In the present invention GLS resistant loci 47, 48, 49, 50, 51, 52, 53, 54, 55, 56, 57, 58, 59, 60, 61, 62, 63, 64, 65, 66, and 67 are located on Chromosome 3. SNP markers used to monitor the introgression of GLS resistance locus 47 include those selected from the group consisting of SEQ ID NOs: 361 through 364. SNP markers used to monitor the introgression of GLS resistance locus 48 include those selected from the group consisting of SEQ ID NOs: 365. SNP markers used to monitor the introgression of GLS resistance locus 49 include those selected from the group consisting of SEQ ID NOs: 366. SNP markers used to monitor the introgression of GLS resistance locus 50 include those selected from the group consisting of SEQ ID NOs: 367 through 369. SNP markers used to monitor the introgression of GLS resistance locus 51 include those selected from the group consisting of SEQ ID NOs: 370 through 371. SNP markers used to monitor the introgression of GLS resistance locus 52 include those selected from the group consisting of SEQ ID NOs: 372 through 374. SNP markers used to monitor the introgression of GLS resistance locus 53 include those selected from the group consisting of SEQ ID NOs: 375. SNP markers used to monitor the introgression of GLS resistance locus 54 include those selected from the group consisting of SEQ ID NOs: 376 through 395. SNP markers used to monitor the introgression of GLS resistance locus 55 include those selected from the group consisting of SEQ ID NOs: 396 through 408. SNP markers used to monitor the introgression of GLS resistance locus 56 include those selected from the group consisting of SEQ ID NOs: 409 through 418. SNP markers used to monitor the introgression of GLS resistance locus 57 include those selected from the group consisting of SEQ ID NOs: 419 through 425. SNP markers used to monitor the introgression of GLS resistance locus 58 include those selected from the group consisting of SEQ ID NOs: 426 through 433. SNP markers used to monitor the introgression of GLS resistance locus 59 include those selected from the group consisting of SEQ ID NOs: 434 through 435. SNP markers used to monitor the introgression of GLS resistance locus 60 include those selected from the group consisting of SEQ ID NOs: 436 through 449. SNP markers used to monitor the introgression of GLS resistance locus 61 include those selected from the group consisting of SEQ ID NOs: 450 through 458. SNP markers used to monitor the introgression of GLS resistance locus 62 include those selected from the group consisting of SEQ ID NOs: 459 through 464. SNP markers used to monitor the introgression of GLS resistance locus 63 include those selected from the group consisting of SEQ ID NOs: 465 through 471. SNP markers used to monitor the introgression of GLS resistance locus 64 include those selected from the group consisting of SEQ ID NOs: 472 through 482. SNP markers used to monitor the introgression of GLS resistance locus 65 include those selected from the group consisting of SEQ ID NOs: 483 through 486. SNP markers used to monitor the introgression of GLS resistance locus 66 include those selected from the group consisting of SEQ ID NOs: 487 through 490. SNP markers used to monitor the introgression of GLS resistance locus 67 include those selected from the group consisting of SEQ ID NOs: 491 through 495.

In the present invention GLS resistant loci 68, 69, 70, 71, 72, 73, 74, 75, 76, 77, 78, 79, 80, 81, 82, 83, 84, 85, 86, and 87 are located on Chromosome 4. SNP markers used to monitor the introgression of GLS resistance locus 68 include those selected from the group consisting of SEQ ID NOs: 496 through 499. SNP markers used to monitor the introgression of GLS resistance locus 69 include those selected from the group consisting of SEQ ID NOs: 500 through 502. SNP markers used to monitor the introgression of GLS resistance locus 70 include those selected from the group consisting of SEQ ID NOs: 503 through 504. SNP markers used to monitor the introgression of GLS resistance locus 71 include those selected from the group consisting of SEQ ID NOs: 505 through 507. SNP markers used to monitor the introgression of GLS resistance locus 72 include those selected from the group consisting of SEQ ID NOs: 508 through 511. SNP markers used to monitor the introgression of GLS resistance locus 73 include those selected from the group consisting of SEQ ID NOs: 512 through 515. SNP markers used to monitor the introgression of GLS resistance locus 74 include those selected from the group consisting of SEQ ID NOs: 516 through 530. SNP markers used to monitor the introgression of GLS resistance locus 75 include those selected from the group consisting of SEQ ID NOs: 531 through 551. SNP markers used to monitor the introgression of GLS resistance locus 76 include those selected from the group consisting of SEQ ID NOs: 552 through 567. SNP markers used to monitor the introgression of GLS resistance locus 77 include those selected from the group consisting of SEQ ID NOs: 568 through 578. SNP markers used to monitor the introgression of GLS resistance locus 78 include those selected from the group consisting of SEQ ID NOs: 579 through 586. SNP markers used to monitor the introgression of GLS resistance locus 79 include those selected from the group consisting of SEQ ID NOs: 587 through 590. SNP markers used to monitor the introgression of GLS resistance locus 80 include those selected from the group consisting of SEQ ID NOs: 591 through 603. SNP markers used to monitor the introgression of GLS resistance locus 81 include those selected from the group consisting of SEQ ID NOs: 604 through 617. SNP markers used to monitor the introgression of GLS resistance locus 82 include those selected from the group consisting of SEQ ID NOs: 618 through 625. SNP markers used to monitor the introgression of GLS resistance locus 83 include those selected from the group consisting of SEQ ID NOs: 626 through 632. SNP markers used to monitor the introgression of GLS resistance locus 84 include those selected from the group consisting of SEQ ID NOs: 633 through 639. SNP markers used to monitor the introgression of GLS resistance locus 85 include those selected from the group consisting of SEQ ID NOs: 640 through 644. SNP markers used to monitor the introgression of GLS resistance locus 86 include those selected from the group consisting of SEQ ID NOs: 645 through 653.

SNP markers used to monitor the introgression of GLS resistance locus 87 include those selected from the group consisting of SEQ ID NOs: 654 through 656.

In the present invention GLS resistant loci 88, 89, 90, 91, 92, 93, 94, 95, 96, 97, 98, 99, 100, 101, 102, 103, and 104 are located on Chromosome 5. SNP markers used to monitor the introgression of GLS resistance locus 88 include those selected from the group consisting of SEQ ID NOs: 657 through 660. SNP markers used to monitor the introgression of GLS resistance locus 89 include those selected from the group consisting of SEQ ID NOs: 661 through 668. SNP markers used to monitor the introgression of GLS resistance locus 90 include those selected from the group consisting of SEQ ID NOs: 669 through 670. SNP markers used to monitor the introgression of GLS resistance locus 91 include those selected from the group consisting of SEQ ID NOs: 671 through 674. SNP markers used to monitor the introgression of GLS resistance locus 92 include those selected from the group consisting of SEQ ID NOs: 675 through 678. SNP markers used to monitor the introgression of GLS resistance locus 93 include those selected from the group consisting of SEQ ID NOs: 679 through 692. SNP markers used to monitor the introgression of GLS resistance locus 94 include those selected from the group consisting of SEQ ID NOs: 693 through 709. SNP markers used to monitor the introgression of GLS resistance locus 95 include those selected from the group consisting of SEQ ID NOs: 710 through 721. SNP markers used to monitor the introgression of GLS resistance locus 96 include those selected from the group consisting of SEQ ID NOs: 722 through 730. SNP markers used to monitor the introgression of GLS resistance locus 97 include those selected from the group consisting of SEQ ID NOs: 731 through 738. SNP markers used to monitor the introgression of GLS resistance locus 98 include those selected from the group consisting of SEQ ID NOs: 739 through 740. SNP markers used to monitor the introgression of GLS resistance locus 99 include those selected from the group consisting of SEQ ID NOs: 741 through 748. SNP markers used to monitor the introgression of GLS resistance locus 100 include those selected from the group consisting of SEQ ID NOs: 749 through 754. SNP markers used to monitor the introgression of GLS resistance locus 101 include those selected from the group consisting of SEQ ID NOs: 755 through 760. SNP markers used to monitor the introgression of GLS resistance locus 102 include those selected from the group consisting of SEQ ID NOs: 761 through 762. SNP markers used to monitor the introgression of GLS resistance locus 103 include those selected from the group consisting of SEQ ID NOs: 763 through 771. SNP markers used to monitor the introgression of GLS resistance locus 104 include those selected from the group consisting of SEQ ID NOs: 772 through 776.

In the present invention GLS resistant loci 105, 106, 107, 108, 109, 110, 111, 112, 113, 114, 115, 116, and 117 are located on Chromosome 6. SNP markers used to monitor the introgression of GLS resistance locus 105 include those selected from the group consisting of SEQ ID NOs: 777 through 780. SNP markers used to monitor the introgression of GLS resistance locus 106 include those selected from the group consisting of SEQ ID NOs: 781 through 812. SNP markers used to monitor the introgression of GLS resistance locus 107 include those selected from the group consisting of SEQ ID NOs: 813 through 820. SNP markers used to monitor the introgression of GLS resistance locus 108 include those selected from the group consisting of SEQ ID NOs: 821 through 829 and 1232. SNP markers used to monitor the introgression of GLS resistance locus 109 include those selected from the group consisting of SEQ ID NOs: 830 through 834. SNP markers used to monitor the introgression of GLS resistance locus 110 include those selected from the group consisting of SEQ ID NOs: 835 through 845 and 1231. SNP markers used to monitor the introgression of GLS resistance locus 111 include those selected from the group consisting of SEQ ID NOs: 846 through 854. SNP markers used to monitor the introgression of GLS resistance locus 112 include those selected from the group consisting of SEQ ID NOs: 855 through 863. SNP markers used to monitor the introgression of GLS resistance locus 113 include those selected from the group consisting of SEQ ID NOs: 864 through 869. SNP markers used to monitor the introgression of GLS resistance locus 114 include those selected from the group consisting of SEQ ID NOs: 870 through 873. SNP markers used to monitor the introgression of GLS resistance locus 115 include those selected from the group consisting of SEQ ID NOs: 874 through 875. SNP markers used to monitor the introgression of GLS resistance locus 116 include those selected from the group consisting of SEQ ID NOs: 876 through 883. SNP markers used to monitor the introgression of GLS resistance locus 117 include those selected from the group consisting of SEQ ID NOs: 884 through 889 and 1360.

In the present invention GLS resistant loci 118, 119, 120, 121, 122, 123, 124, 125, 126, 127, 128, 129, 130, 131, 132, 133, 134, and 135 are located on Chromosome 7. SNP markers used to monitor the introgression of GLS resistance locus 118 include those selected from the group consisting of SEQ ID NOs: 890 through 891. SNP markers used to monitor the introgression of GLS resistance locus 119 include those selected from the group consisting of SEQ ID NOs: 892. SNP markers used to monitor the introgression of GLS resistance locus 120 include those selected from the group consisting of SEQ ID NOs: 893. SNP markers used to monitor the introgression of GLS resistance locus 121 include those selected from the group consisting of SEQ ID NOs: 894. SNP markers used to monitor the introgression of GLS resistance locus 122 include those selected from the group consisting of SEQ ID NOs: 895 through 898. SNP markers used to monitor the introgression of GLS resistance locus 123 include those selected from the group consisting of SEQ ID NOs: 899 through 907. SNP markers used to monitor the introgression of GLS resistance locus 124 include those selected from the group consisting of SEQ ID NOs: 908 through 932. SNP markers used to monitor the introgression of GLS resistance locus 125 include those selected from the group consisting of SEQ ID NOs: 933 through 939. SNP markers used to monitor the introgression of GLS resistance locus 126 include those selected from the group consisting of SEQ ID NOs: 940 through 943. SNP markers used to monitor the introgression of GLS resistance locus 127 include those selected from the group consisting of SEQ ID NOs: 944 through 953 and 1233. SNP markers used to monitor the introgression of GLS resistance locus 128 include those selected from the group consisting of SEQ ID NOs: 954 through 963. SNP markers used to monitor the introgression of GLS resistance locus 129 include those selected from the group consisting of SEQ ID NOs: 964 through 968. SNP markers used to monitor the introgression of GLS resistance locus 130 include those selected from the group consisting of SEQ ID NOs: 969 through 971. SNP markers used to monitor the introgression of GLS resistance locus 131 include those selected from the group consisting of SEQ ID NOs: 972 through 976. SNP markers used to monitor the introgression of GLS resistance locus 132 include those selected from the group consisting of SEQ ID NOs: 977. SNP markers used to monitor the introgression of GLS resistance locus 133 include those selected from the group consisting of SEQ ID NOs: 978 through 982. SNP markers used to monitor the introgression of GLS resistance locus 134 include those selected from the group consisting of SEQ ID NOs: 983 through 990. SNP markers used to monitor the introgression of GLS resistance locus 135 include those selected from the group consisting of SEQ ID NOs: 991 through 996.

In the present invention GLS resistant loci 136, 137, 138, 139, 140, 141, 142, 143, 144, 145, 146, 147, 148, and 149 are located on Chromosome 8. SNP markers used to monitor the introgression of GLS resistance locus 136 include those selected from the group consisting of SEQ ID NOs: 997 through 1000. SNP markers used to monitor the introgression of GLS resistance locus 137 include those selected from the group consisting of SEQ ID NOs: 1001 through 1003. SNP markers used to monitor the introgression of GLS resistance locus 138 include those selected from the group consisting of SEQ ID NOs: 1004 through 1010. SNP markers used to monitor the introgression of GLS resistance locus 139 include those selected from the group consisting of SEQ ID NOs: 1011 through 1015. SNP markers used to monitor the introgression of GLS resistance locus 140 include those selected from the group consisting of SEQ ID NOs: 1016 through 1022. SNP markers used to monitor the introgression of GLS resistance locus 141 include those selected from the group consisting of SEQ ID NOs: 1023 through 1031. SNP markers used to monitor the introgression of GLS resistance locus 142 include those selected from the group consisting of SEQ ID NOs: 1032 through 1046. SNP markers used to monitor the introgression of GLS resistance locus 143 include those selected from the group consisting of SEQ ID NOs: 1047 through 1050. SNP markers used to monitor the introgression of GLS resistance locus 144 include those selected from the group consisting of SEQ ID NOs: 1051 through 1060. SNP markers used to monitor the introgression of GLS resistance locus 145 include those selected from the group consisting of SEQ ID NOs: 1061 through 1062. SNP markers used to monitor the introgression of GLS resistance locus 146 include those selected from the group consisting of SEQ ID NOs: 1063 through 1069. SNP markers used to monitor the introgression of GLS resistance locus 147 include those selected from the group consisting of SEQ ID NOs: 1070 through 1072. SNP markers used to monitor the introgression of GLS resistance locus 148 include those selected from the group consisting of SEQ ID NOs: 1073 through 1075. SNP markers used to monitor the introgression of GLS resistance locus 149 include those selected from the group consisting of SEQ ID NOs: 1076 through 1078.

In the present invention GLS resistant loci 150, 151, 152, 153, 154, 155, 156, 157, 158, 159, 160, 161, 162, 163, 164, and 165 are located on Chromosome 9. SNP markers used to monitor the introgression of GLS resistance locus 150 include those selected from the group consisting of SEQ ID NOs: 1079 through 1081. SNP markers used to monitor the introgression of GLS resistance locus 151 include those selected from the group consisting of SEQ ID NOs: 1082 through 1086. SNP markers used to monitor the introgression of GLS resistance locus 152 include those selected from the group consisting of SEQ ID NOs: 1087. SNP markers used to monitor the introgression of GLS resistance locus 153 include those selected from the group consisting of SEQ ID NOs: 1088 through 1091. SNP markers used to monitor the introgression of GLS resistance locus 154 include those selected from the group consisting of SEQ ID NOs: 1092 through 1096. SNP markers used to monitor the introgression of GLS resistance locus 155 include those selected from the group consisting of SEQ ID NOs: 1097 through 1098. SNP markers used to monitor the introgression of GLS resistance locus 156 include those selected from the group consisting of SEQ ID NOs: 1099 through 1110. SNP markers used to monitor the introgression of GLS resistance locus 157 include those selected from the group consisting of SEQ ID NOs: 1111 through 1118. SNP markers used to monitor the introgression of GLS resistance locus 158 include those selected from the group consisting of SEQ ID NOs: 1119 through 1133 and 1127. SNP markers used to monitor the introgression of GLS resistance locus 159 include those selected from the group consisting of SEQ ID NOs: 1134 through 1142. SNP markers used to monitor the introgression of GLS resistance locus 160 include those selected from the group consisting of SEQ ID NOs: 1143 through 1150. SNP markers used to monitor the introgression of GLS resistance locus 161 include those selected from the group consisting of SEQ ID NOs: 1151 through 1157. SNP markers used to monitor the introgression of GLS resistance locus 162 include those selected from the group consisting of SEQ ID NOs: 1158 through 1159. SNP markers used to monitor the introgression of GLS resistance locus 163 include those selected from the group consisting of SEQ ID NOs: 1160 through 1164. SNP markers used to monitor the introgression of GLS resistance locus 164 include those selected from the group consisting of SEQ ID NOs: 1165. SNP markers used to monitor the introgression of GLS resistance locus 165 include those selected from the group consisting of SEQ ID NOs: 1166 through 1167.

In the present invention GLS resistant loci 166, 167, 168, 169, 170, 171, 172, 173, 174, 175, and 176 are located on Chromosome 10. SNP markers used to monitor the introgression of GLS resistance locus 166 include those selected from the group consisting of SEQ ID NOs: 1168. SNP markers used to monitor the introgression of GLS resistance locus 167 include those selected from the group consisting of SEQ ID NOs: 1169 through 1172. SNP markers used to monitor the introgression of GLS resistance locus 168 include those selected from the group consisting of SEQ ID NOs: 1173 through 1177. SNP markers used to monitor the introgression of GLS resistance locus 169 include those selected from the group consisting of SEQ ID NOs: 1178 through 1192. SNP markers used to monitor the introgression of GLS resistance locus 170 include those selected from the group consisting of SEQ ID NOs: 1193 through 1203 and 1361. SNP markers used to monitor the introgression of GLS resistance locus 171 include those selected from the group consisting of SEQ ID NOs: 1204 through 1210. SNP markers used to monitor the introgression of GLS resistance locus 172 include those selected from the group consisting of SEQ ID NOs: 1211 through 1215. SNP markers used to monitor the introgression of GLS resistance locus 173 include those selected from the group consisting of SEQ ID NOs: 1216 through 1219. SNP markers used to monitor the introgression of GLS resistance locus 174 include those selected from the group consisting of SEQ ID NOs: 1220 through 1221. SNP markers used to monitor the introgression of GLS resistance locus 175 include those selected from the group consisting of SEQ ID NOs: 1222 through 1226. SNP markers used to monitor the introgression of GLS resistance locus 176 include SEQ ID NO: 1227.

Exemplary marker assays for screening for GLS resistance loci are provided in Tables 3, 4, and 5. Illustrative GLS resistance locus 173 SNP marker DNA sequence SEQ ID NO: 1219 can be amplified using the primers indicated as SEQ ID NOs: 1304 through 1305 and detected with probes indicated as SEQ ID NOs: 1306 through 1307. Illustrative GLS resistance locus 57 SNP marker DNA sequence SEQ ID NO: 421 can be amplified using the primers indicated as SEQ ID NOs: 1308 through 1309 and detected with probes indicated as SEQ ID NOs: 1310 through 1311. Illustrative GLS resistance locus 64 SNP marker DNA sequence SEQ ID NO: 481 can be amplified using the primers indicated as SEQ ID NOs: 1312 through 1313 and detected with probes indicated as SEQ ID NOs: 1314 through 1315. Illustrative GLS resistance locus 176 SNP marker DNA sequence SEQ ID NO: 1127 can be amplified using the primers indicated as SEQ ID NOs: 1316 through 1317 and detected with probes indicated as SEQ ID NOs: 1318 through 1319. Illustrative oligonucleotide hybridization probes for GLS resistance locus 173 SNP marker DNA sequence SEQ ID NO: 1219 are provided as SEQ ID NO: 1320 and SEQ ID NO 1321. Illustrative oligonucleotide hybridization probes for GLS resistance locus 57 SNP marker DNA sequence SEQ ID NO: 421 are provided as SEQ ID NO: 1322 and SEQ ID NO: 1323. Illustrative oligonucleotide hybridization probes for GLS resistance locus 64 SNP marker DNA sequence SEQ ID NO: 481 are provided as SEQ ID NO: 1324 and SEQ ID NO: 1325. Illustrative oligonucleotide hybridization probes for GLS resistance locus 176 SNP marker DNA sequence SEQ ID NO: 1127 are provided as SEQ ID NO: 1326 and SEQ ID NO: 1327. An illustrative probe for single base extension assays for GLS resistance locus 173 SNP marker DNA sequence SEQ ID NO: 1219 is provided as SEQ ID NO: 1328. An illustrative probe for single base extension assays for GLS resistance locus 57 SNP marker DNA sequence SEQ ID NO: 421 is provided as SEQ ID NO: 1329. An illustrative probe for single base extension assays for GLS resistance locus 64 SNP marker DNA sequence SEQ ID NO: 481 is provided as SEQ ID NO: 1330. An illustrative probe for single base extension assays for GLS resistance locus 176 SNP marker DNA sequence SEQ ID NO: 1127 is provided as SEQ ID NO: 1331.

The present invention also provides a corn plant comprising a nucleic acid molecule selected from the group consisting of SEQ ID NO: 1 through 1233, 1360, and 1361, fragments thereof, and complements of both.

As used herein, GLS refers to any Gray Leaf Spot variant or isolate. A corn plant of the present invention can be resistant to one or more fungi capable of causing or inducing GLS. In one aspect, the present invention provides plants resistant to GLS as well as methods and compositions for screening corn plants for resistance or susceptibility to GLS, caused by the genus *Cercospora*. In a preferred aspect, the present invention provides methods and compositions for screening corn plants for resistance or susceptibility to *C. zea-maydis*. In another aspect, the present invention provides plants resistant to and methods and compositions for screening corn plants for resistance or susceptibility to *C. zea-maydis* strain "Type I." In a further aspect, the present invention provides plants resistant to and methods and compositions for screening corn plants for resistance or susceptibility to *C. zea-maydis* strain "Type II." In an additional aspect, the present invention provides plants resistant to and methods and compositions for screening corn plants for resistance or susceptibility to *C. sorghi* var. *maydis*.

In an aspect, the plant is selected from the genus *Zea*. In another aspect, the plant is selected from the species *Zea mays*. In a further aspect, the plant is selected from the subspecies *Zea mays* L. ssp. *mays*. In an additional aspect, the plant is selected from the group *Zea mays* L. subsp. *mays* Indentata, otherwise known as dent corn. In another aspect, the plant is selected from the group *Zea mays* L. subsp. *mays* Indurata, otherwise known as flint corn. In another an aspect, the plant is selected from the group *Zea mays* L. subsp. *mays* Saccharata, otherwise known as sweet corn. In another aspect, the plant is selected from the group *Zea mays* L. subsp. *mays* Amylacea, otherwise known as flour corn. In a further aspect, the plant is selected from the group *Zea mays* L. subsp. *mays* Everta, otherwise known as pop corn. *Zea* plants include hybrids, inbreds, partial inbreds, or members of defined or undefined populations.

Plants of the present invention can be a corn plant that is very resistant, resistant, substantially resistant, mid-resistant, comparatively resistant, partially resistant, mid-susceptible, or susceptible.

In a preferred aspect, the present invention provides a corn plant to be assayed for resistance or susceptibility to GLS by any method to determine whether a corn plant is very resistant, resistant, substantially resistant, mid-resistant, comparatively resistant, partially resistant, mid-susceptible, or susceptible. Phenotyping for GLS is based on visually screening plants to determine percentage of infected leaf area. The percentage of leaf area infected is used to rate plants on a scale of 1 (very resistant) to 9 (susceptible). Disease resistance is evaluated visually after pollination. The infection can be natural or from artificial inoculation.

A disease resistance QTL of the present invention may be introduced into an elite corn inbred line.

In another aspect, the corn plant can show a comparative resistance compared to a non-resistant control corn plant. In this aspect, a control corn plant will preferably be genetically similar except for the GLS resistant allele or alleles in question. Such plants can be grown under similar conditions with equivalent or near equivalent exposure to the pathogen. In this aspect, the resistant plant or plants has less than 25%, 15%, 10%, 5%, 2% or 1% of leaf area infected.

A disease resistance QTL of the present invention may be introduced into an elite corn inbred line. An "elite line" is any line that has resulted from breeding and selection for superior agronomic performance.

A GLS resistance QTL of the present invention may also be introduced into an elite corn plant comprising one or more transgenes conferring herbicide tolerance, increased yield, insect control, fungal disease resistance, virus resistance, nematode resistance, bacterial disease resistance, mycoplasma disease resistance, modified oils production, high oil production, high protein production, germination and seedling growth control, enhanced animal and human nutrition, low raffinose, environmental stress resistant, increased digestibility, industrial enzymes, pharmaceutical proteins, peptides and small molecules, improved processing traits, improved flavor, nitrogen fixation, hybrid seed production, reduced allergenicity, biopolymers, and biofuels among others. In one aspect, the herbicide tolerance is selected from the group consisting of glyphosate, dicamba, glufosinate, sulfonylurea, bromoxynil and norflurazon herbicides. These traits can be provided by methods of plant biotechnology as transgenes in corn.

A disease resistant QTL allele or alleles can be introduced from any plant that contains that allele (donor) to any recipient corn plant. In one aspect, the recipient corn plant can contain additional GLS resistant loci. In another aspect, the recipient corn plant can contain a transgene. In another aspect, while maintaining the introduced QTL, the genetic contribution of the plant providing the disease resistant QTL can be reduced by back-crossing or other suitable approaches. In one aspect, the nuclear genetic material derived from the donor material in the corn plant can be less than or about 50%, less than or about 25%, less than or about 13%, less than or about 5%, 3%, 2% or 1%, but that genetic material contains the GLS resistant locus or loci of interest.

It is further understood that a corn plant of the present invention may exhibit the characteristics of any relative maturity group. In an aspect, the maturity group is selected from the group consisting of RM90-95, RM 95-100, RM 100-105, RM 105-110, RM 110-115, and RM 115-120.

An allele of a QTL can, of course, comprise multiple genes or other genetic factors even within a contiguous genomic region or linkage group, such as a haplotype. As used herein, an allele of a disease resistance locus can therefore encompass more than one gene or other genetic factor where each individual gene or genetic component is also capable of exhibiting allelic variation and where each gene or genetic factor is also capable of eliciting a phenotypic effect on the quantitative trait in question. In an aspect of the present invention the allele of a QTL comprises one or more genes or other genetic factors that are also capable of exhibiting allelic variation. The use of the term "an allele of a QTL" is thus not intended to exclude a QTL that comprises more than one gene or other genetic factor. Specifically, an "allele of a QTL" in the present in the invention can denote a haplotype within a haplotype window wherein a phenotype can be disease resistance. A haplotype window is a contiguous genomic region that can be defined, and tracked, with a set of one or more polymorphic markers wherein the polymorphisms indicate identity by descent. A haplotype within that window can be defined by the unique fingerprint of alleles at each marker. As used herein, an allele is one of several alternative forms of a gene occupying a given locus on a chromosome. When all the alleles present at a given locus on a chromosome are the same, that plant is homozygous at that locus. If the alleles present at a given locus on a chromosome differ, that plant is heterozygous at that locus. Plants of the present invention may be homozygous or heterozygous at any particular GLS locus or for a particular polymorphic marker.

The present invention also provides for parts of the plants of the present invention. Plant parts, without limitation, include seed, endosperm, ovule and pollen. In a particularly preferred aspect of the present invention, the plant part is a seed.

The present invention also provides a container of corn in which greater than 50%, 60%, 70%, 80%, 90%, 95%, or 99% of the seeds comprising 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, and 178 GLS resistant loci where one or more alleles at one or more of their loci are selected from the group consisting of SEQ ID NOs 1-1233, 1360, and 1361.

The container of corn seeds can contain any number, weight, or volume of seeds. For example, a container can contain at least, or greater than, about 10, 25, 50, 100, 200, 300, 400, 500, 600, 700, 80, 90, 1000, 1500, 2000, 2500, 3000, 3500, 4000 or more seeds. In another aspect, a container can contain about, or greater than about, 1 gram, 5 grams, 10 grams, 15 grams, 20 grams, 25 grams, 50 grams, 100 grams, 250 grams, 500 grams, or 1000 grams of seeds. Alternatively, the container can contain at least, or greater than, about 0 ounces, 1 ounce, 5 ounces, 10 ounces, 1 pound, 2 pounds, 3 pounds, 4 pounds, 5 pounds, 10 pounds, 15 pounds, 20 pounds, 25 pounds, or 50 pounds or more seeds.

Containers of corn seeds can be any container available in the art. For example, a container can be a box, a bag, a can, a packet, a pouch, a tape roll, a pail, or a tube.

In another aspect, the seeds contained in the containers of corn seeds can be treated or untreated corn seeds. In one aspect, the seeds can be treated to improve germination, for example, by priming the seeds, or by disinfection to protect against seed-born pathogens. In another aspect, seeds can be coated with any available coating to improve, for example, plantability, seed emergence, and protection against seed-born pathogens. Seed coating can be any form of seed coating including, but not limited to, pelleting, film coating, and encrustments.

Plants of the present invention may also be grown in culture and regenerated. Methods for the regeneration of *Zea mays* plants from various tissue types and methods for the tissue culture of *Zea mays* are known in the art (for example, Bhaskaran et al., 1990 Crop Sci. 30:1328-1336). Regeneration techniques for plants such as *Zea mays* can use as the starting material a variety of tissue or cell types. With *Zea mays* in particular, regeneration processes have been developed that begin with certain differentiated tissue types such as meristems, (Sairam et al., 2003 *Genome* 46:323-3). Regeneration of mature *Zea mays* plants from tissue culture by organogenesis and embryogenesis has also been reported (Wang 1987 *Plant Cell. Rep.* 6:360-362; Chang 1983 *Plant Cell. Rep.* 2:18-185; Green et al. 1975 Crop Sci, 15:417-421). Recently, regeneration of corn from split seeds was also reported (Al-Abed et al., 2006 *Planta* 223:1355-1366).

The present invention also provides a disease resistant corn plant selected for by screening for disease resistance or susceptibility in the corn plant, the selection comprising interrogating genomic nucleic acids for the presence of a marker molecule that is genetically linked to an allele of a QTL associated with disease resistance in the corn plant, where the allele of a QTL is also located on a linkage group associated with disease resistant GLS.

Nucleic Acids

The present invention includes isolated nucleic acid molecules. Such molecules include those nucleic acid molecules capable of detecting a polymorphism genetically or physically linked to a Gray Leaf Spot Resistance loci. In certain embodiments, the isolated nucleic acid molecule is selected from the group consisting of SEQ ID NOs: 1-62, 64-70, 72-156, 158-172, 174-187, 189-377, 379, 380, 382-409, 411-

459, 461-1233, 1360, 1361, fragments thereof, complements thereof, and nucleic acid molecules capable of specifically hybridizing to one or more of these nucleic acid molecules.

In one embodiment, an isolated nucleic acid molecule of the present invention includes those that will specifically hybridize to one or more of the nucleic acid molecules set forth in of SEQ ID NOs: 1-62, 64-70, 72-156, 158-172, 174-187, 189-377, 379, 380, 382-409, 411-459, 461-1233, 1360, 1361 and complements thereof under stringent hybridization conditions of 20×SSC and about 65 degrees C. In a further aspect of the present invention, a preferred marker nucleic acid molecule of the present invention shares between 95% and 100% sequence identity with the sequences set forth in SEQ ID NOs: 1-62, 64-70, 72-156, 158-172, 174-187, 189-377, 379, 380, 382-409, 411-459, 461-1233, 1360, 1361 or complements thereof or fragments of either. In a more preferred aspect of the present invention, a preferred marker nucleic acid molecule of the present invention shares between 98% and 100% sequence identity with the nucleic acid sequence set forth in SEQ ID NOs: 1-62, 64-70, 72-156, 158-172, 174-187, 189-377, 379, 380, 382-409, 411-459, 461-1233, 1360, 1361 or complement thereof or fragments of either.

Nucleic acid molecules or fragments thereof are capable of specifically hybridizing to other nucleic acid molecules under certain circumstances. As used herein, two nucleic acid molecules are capable of specifically hybridizing to one another if the two molecules are capable of forming an anti-parallel, double-stranded nucleic acid structure. A nucleic acid molecule is the "complement" of another nucleic acid molecule if they exhibit complete complementarity. As used herein, molecules are exhibit "complete complementarity" when every nucleotide of one of the molecules is complementary to a nucleotide of the other. Two molecules are "minimally complementary" if they can hybridize to one another with sufficient stability to permit them to remain annealed to one another under at least conventional "low-stringency" conditions. Similarly, the molecules are "complementary" if they can hybridize to one another with sufficient stability to permit them to remain annealed to one another under conventional "high-stringency" conditions. Conventional stringency conditions are described by Sambrook et al., In: *Molecular Cloning, A Laboratory Manual, 2nd Edition*, Cold Spring Harbor Press, Cold Spring Harbor, N.Y. (1989), and by Haymes et al., In: *Nucleic Acid Hybridization, A Practical Approach*, IRL Press, Washington, D.C. (1985). Departures from complete complementarity are therefore permissible, as long as such departures do not completely preclude the capacity of the molecules to form a double-stranded structure. In order for a nucleic acid molecule to serve as a primer or probe it need only be sufficiently complementary in sequence to be able to form a stable double-stranded structure under the particular solvent and salt concentrations employed.

As used herein, a substantially homologous sequence is a nucleic acid sequence that will specifically hybridize to the complement of the nucleic acid sequence to which it is being compared under high stringency conditions. The nucleic-acid probes and primers of the present invention can hybridize under stringent conditions to a target DNA sequence. The term "stringent hybridization conditions" is defined as conditions under which a probe or primer hybridizes specifically with a target sequence(s) and not with non-target sequences, as can be determined empirically. The term "stringent conditions" is functionally defined with regard to the hybridization of a nucleic-acid probe to a target nucleic acid (i.e., to a particular nucleic-acid sequence of interest) by the specific hybridization procedure discussed in Sambrook et al., 1989, at 9.52-9.55. See also, Sambrook et al., 1989 at 9.47-9.52, 9.56-9.58; Kanehisa 1984 Nucl. Acids Res. 12:203-213; and Wetmur et al., 1968 J. Mol. Biol. 31:349-370. Appropriate stringency conditions that promote DNA hybridization are, for example, 6.0× sodium chloride/sodium citrate (SSC) at about 45° C., followed by a wash of 2.0×SSC at 50° C., are known to those skilled in the art or can be found in Current Protocols in Molecular Biology, John Wiley & Sons, N.Y., 1989, 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

For example, hybridization using DNA or RNA probes or primers can be performed at 65° C. in 6×SSC, 0.5% SDS, 5×Denhardt's, 100 µg/mL nonspecific DNA (e.g., sonicated salmon sperm DNA) with washing at 0.5×SSC, 0.5% SDS at 65° C., for high stringency.

It is contemplated that lower stringency hybridization conditions such as lower hybridization and/or washing temperatures can be used to identify related sequences having a lower degree of sequence similarity if specificity of binding of the probe or primer to target sequence(s) is preserved. Accordingly, the nucleotide sequences of the present invention can be used for their ability to selectively form duplex molecules with complementary stretches of DNA, RNA, or cDNA fragments.

A fragment of a nucleic acid molecule provided herein can be of any size. Fragments provided herein include, but are not limited to, fragments of nucleic acid sequences set forth in SEQ ID NO: 1-62, 64-70, 72-156, 158-172, 174-187, 189-377, 379, 380, 382-409, 411-459, 461-1233, 1360 and 1361. In one aspect, a fragment of a nucleic acid molecule can be 15 to 25, 15 to 30, 15 to 40, 15 to 50, 15 to 100, 20 to 25, 20 to 30, 20 to 40, 20 to 50, 20 to 100, 25 to 30, 25 to 40, 25 to 50, 25 to 100, 30 to 40, 30 to 50, or 30 to 100 nucleotides in length. In another aspect, the fragment can be greater than 10, 15, 20, 25, 30, 35, 40, 50, 100, or 250 nucleotides in length.

Additional genetic markers can be used to select plants with an allele of a QTL associated with Goss' Wilt resistance. Examples of public marker databases include, but are not limited to, the Maize Genome Database located at the world wide web at maizegdb.org, the MaizeSeq database located on the world wide web at maizeseq.org, the Panzea maize marker and map database located on the world wide web at panzea.org, and the MAGI database located on the world wide web at plantgenomics.iastate.edu/maize.

Marker Technology

Genetic markers of the present invention include "dominant" or "codominant" markers. "Codominant markers" reveal the presence of two or more alleles (two per diploid individual). "Dominant markers" reveal the presence of only a single allele. The presence of the dominant marker phenotype (e.g., a band of DNA) is an indication that one allele is present in either the homozygous or heterozygous condition. The absence of the dominant marker phenotype (e.g., absence of a DNA band) is merely evidence that "some other" undefined allele is present. In the case of populations where individuals are predominantly homozygous and loci are predominantly dimorphic, dominant and codominant markers can be equally valuable. As populations become more heterozygous and multiallelic, codominant markers often become more informative of the genotype than dominant markers.

In another embodiment, markers, such as single sequence repeat markers (SSR), AFLP markers, RFLP markers, RAPD markers, phenotypic markers, isozyme markers, single nucleotide polymorphisms (SNPs), insertions or deletions (Indels), single feature polymorphisms (SFPs, for example, as described in Borevitz et al., 2003 Gen. Res. 13:513-523), microarray transcription profiles, DNA-derived sequences, and RNA-derived sequences that are genetically linked to or correlated with alleles of a QTL of the present invention can be utilized.

In one embodiment, nucleic acid-based analyses for the presence or absence of the genetic polymorphism can be used for the selection of seeds in a breeding population. A wide variety of genetic markers for the analysis of genetic polymorphisms are available and known to those of skill in the art. The analysis may be used to select for genes, QTL, alleles, or genomic regions (haplotypes) that comprise or are linked to a genetic marker.

Herein, nucleic acid analysis methods are known in the art and include, but are not limited to, PCR-based detection methods (for example, TaqMan assays), microarray methods, and nucleic acid sequencing methods. In one embodiment, the detection of polymorphic sites in a sample of DNA, RNA, or cDNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis, fluorescence detection methods, or other means.

A method of achieving such amplification employs the polymerase chain reaction (PCR) (Mullis et al., 1986 Cold Spring Harbor Symp. Quant. Biol. 51:263-273; European Patent 50,424; European Patent 84,796; European Patent 258, 017; European Patent 237,362; European Patent 201,184; U.S. Pat. No. 4,683,202; U.S. Pat. No. 4,582,788; and U.S. Pat. No. 4,683,194), using primer pairs that are capable of hybridizing to the proximal sequences that define a polymorphism in its double-stranded form.

Polymorphisms in DNA sequences can be detected or typed by a variety of effective methods well known in the art including, but not limited to, those disclosed in U.S. Pat. Nos. 5,468,613 and 5,217,863; 5,210,015; 5,876,930; 6,030,787; 6,004,744; 6,013,431; 5,595,890; 5,762,876; 5,945,283; 5,468,613; 6,090,558; 5,800,944; and 5,616,464, all of which are incorporated herein by reference in their entireties. However, the compositions and methods of this invention can be used in conjunction with any polymorphism typing method to type polymorphisms in corn genomic DNA samples. These corn genomic DNA samples used include but are not limited to, corn genomic DNA isolated directly from a corn plant, cloned corn genomic DNA, or amplified corn genomic DNA.

For instance, polymorphisms in DNA sequences can be detected by hybridization to allele-specific oligonucleotide (ASO) probes as disclosed in U.S. Pat. Nos. 5,468,613 and 5,217,863. U.S. Pat. No. 5,468,613 discloses allele specific oligonucleotide hybridizations where single or multiple nucleotide variations in nucleic acid sequence can be detected in nucleic acids by a process in which the sequence containing the nucleotide variation is amplified, spotted on a membrane and treated with a labeled sequence-specific oligonucleotide probe.

Target nucleic acid sequence can also be detected by probe ligation methods as disclosed in U.S. Pat. No. 5,800,944 where sequence of interest is amplified and hybridized to probes followed by ligation to detect a labeled part of the probe.

Microarrays can also be used for polymorphism detection, wherein oligonucleotide probe sets are assembled in an overlapping fashion to represent a single sequence such that a difference in the target sequence at one point would result in partial probe hybridization (Borevitz et al., Genome Res. 13:513-523 (2003); Cui et al., Bioinformatics 21:3852-3858 (2005). On any one microarray, it is expected there will be a plurality of target sequences, which may represent genes and/or noncoding regions wherein each target sequence is represented by a series of overlapping oligonucleotides, rather than by a single probe. This platform provides for high throughput screening a plurality of polymorphisms. A single-feature polymorphism (SFP) is a polymorphism detected by a single probe in an oligonucleotide array, wherein a feature is a probe in the array. Typing of target sequences by microarray-based methods is disclosed in U.S. Pat. Nos. 6,799,122; 6,913,879; and 6,996,476.

Target nucleic acid sequence can also be detected by probe linking methods as disclosed in U.S. Pat. No. 5,616,464 employing at least one pair of probes having sequences homologous to adjacent portions of the target nucleic acid sequence and having side chains which non-covalently bind to form a stem upon base pairing of said probes to said target nucleic acid sequence. At least one of the side chains has a photoactivatable group which can form a covalent cross-link with the other side chain member of the stem.

Other methods for detecting SNPs and Indels include single base extension (SBE) methods. Examples of SBE methods include, but are not limited, to those disclosed in U.S. Pat. Nos. 6,004,744; 6,013,431; 5,595,890; 5,762,876; and 5,945,283. SBE methods are based on extension of a nucleotide primer that is immediately adjacent to a polymorphism to incorporate a detectable nucleotide residue upon extension of the primer. In certain embodiments, the SBE method uses three synthetic oligonucleotides. Two of the oligonucleotides serve as PCR primers and are complementary to sequence of the locus of corn genomic DNA which flanks a region containing the polymorphism to be assayed. Following amplification of the region of the corn genome containing the polymorphism, the PCR product is mixed with the third oligonucleotide (called an extension primer) which is designed to hybridize to the amplified DNA immediately adjacent to the polymorphism in the presence of DNA polymerase and two differentially labeled dideoxynucleosidetriphosphates. If the polymorphism is present on the template, one of the labeled dideoxynucleosidetriphosphates can be added to the primer in a single base chain extension. The allele present is then inferred by determining which of the two differential labels was added to the extension primer. Homozygous samples will result in only one of the two labeled bases being incorporated and thus only one of the two labels will be detected. Heterozygous samples have both alleles present, and will thus direct incorporation of both labels (into different molecules of the extension primer) and thus both labels will be detected.

In a preferred method for detecting polymorphisms, SNPs and Indels can be detected by methods disclosed in U.S. Pat. Nos. 5,210,015; 5,876,930; and 6,030,787 in which an oligonucleotide probe having a 5'fluorescent reporter dye and a 3'quencher dye covalently linked to the 5' and 3' ends of the probe. When the probe is intact, the proximity of the reporter dye to the quencher dye results in the suppression of the reporter dye fluorescence, e.g. by Forster-type energy transfer. During PCR forward and reverse primers hybridize to a specific sequence of the target DNA flanking a polymorphism while the hybridization probe hybridizes to polymorphism-containing sequence within the amplified PCR product. In the subsequent PCR cycle DNA polymerase with 5'→3' exonuclease activity cleaves the probe and separates the reporter dye from the quencher dye resulting in increased fluorescence of the reporter.

Marker-Trait Associations

For the purpose of QTL mapping, the markers included should be diagnostic of origin in order for inferences to be made about subsequent populations. SNP markers are ideal for mapping because the likelihood that a particular SNP allele is derived from independent origins in the extant populations of a particular species is very low. As such, SNP markers are useful for tracking and assisting introgression of QTLs, particularly in the case of haplotypes.

The genetic linkage of additional marker molecules can be established by a gene mapping model such as, without limitation, the flanking marker model reported by Lander et al., (Lander et al. 1989 Genetics, 121:185-199), and the interval mapping, based on maximum likelihood methods described therein, and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, XXell University, Ithaca, N.Y.). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL). The LOD score essentially indicates how much more likely the data are to have arisen assuming the presence of a QTL versus in its absence. The LOD threshold value for avoiding a false positive with a given confidence, say 95%, depends on the number of markers and the length of the genome. Graphs indicating LOD thresholds are set forth in Lander et al. (1989), and further described by Arús and Moreno-González, *Plant Breeding*, Hayward, Bosemark, Romagosa (eds.) Chapman & Hall, London, pp. 314-331 (1993).

Additional models can be used. Many modifications and alternative approaches to interval mapping have been reported, including the use of non-parametric methods (Kruglyak et al., 1995 Genetics, 139:1421-1428). Multiple regression methods or models can also be used, in which the trait is regressed on a large number of markers (Jansen, *Biometrics in Plant Breed*, van Oijen, Jansen (eds.) Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994)). Procedures combining interval mapping with regression analysis, whereby the phenotype is regressed onto a single putative QTL at a given marker interval, and at the same time onto a number of markers that serve as 'cofactors,' have been reported by Jansen et al. (Jansen et al., 1994 Genetics, 136:1447-1455) and Zeng (Zeng 1994 Genetics 136: 1457-1468). Generally, the use of cofactors reduces the bias and sampling error of the estimated QTL positions (Utz and Melchinger, *Biometrics in Plant Breeding*, van Oijen, Jansen (eds.) Proceedings of the Ninth Meeting of the Eucarpia Section Biometrics in Plant Breeding, The Netherlands, pp. 195-204 (1994), thereby improving the precision and efficiency of QTL mapping (Zeng 1994). These models can be extended to multi-environment experiments to analyze genotype-environment interactions (Jansen et al., 1995 Theor. Appl. Genet. 91:33-3).

Selection of appropriate mapping populations is important to map construction. The choice of an appropriate mapping population depends on the type of marker systems employed (Tanksley et al., *Molecular mapping in plant chromosomes. chromosome structure and function: Impact of new concepts* J. P. Gustafson and R. Appels (eds.). Plenum Press, New York, pp. 157-173 (1988)). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted× adapted).

An $F_2$ population is the first generation of selfing. Usually a single $F_1$ plant is selfed to generate a population segregating for all the genes in Mendelian (1:2:1) fashion. Maximum genetic information is obtained from a completely classified $F_2$ population using a codominant marker system (Mather, Measurement of Linkage in Heredity: Methuen and Co., (1938)). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., 1992 Proc. Natl. Acad. Sci. (USA) 89:1477-1481). However, as the distance between markers becomes larger (i.e., loci become more independent), the information in RIL populations decreases dramatically.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., 1992). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 0.15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., 1991 Proc. Natl. Acad. Sci. (U.S.A.) 88:9828-9832). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

Marker-Assisted Breeding

Further, the present invention contemplates that preferred haploid plants comprising at least one genotype of interest are identified using the methods disclosed in U.S. Patent Application Ser. No. 60/837,864, which is incorporated herein by reference in its entirety, wherein a genotype of interest may correspond to a QTL or haplotype and is associated with at least one phenotype of interest. The methods include association of at least one haplotype with at least one phenotype, wherein the association is represented by a numerical value and the numerical value is used in the decision-making of a breeding program. Non-limiting examples of numerical values include haplotype effect estimates, haplotype frequencies, and breeding values. In the present invention, it is particularly useful to identify haploid plants of interest based on at least one genotype, such that only those lines undergo doubling, which saves resources. Resulting doubled haploid plants comprising at least one genotype of interest are then advanced in a breeding program for use in activities related to germplasm improvement.

In the present invention, haplotypes are defined on the basis of one or more polymorphic markers within a given haplotype window, with haplotype windows being distributed throughout the crop's genome. In another aspect, de novo and/or historical marker-phenotype association data are leverage to infer haplotype effect estimates for one or more phenotypes for one or more of the haplotypes for a crop. Haplotype effect estimates enable one skilled in the art to make breeding decisions by comparing haplotype effect estimates for two or more haplotypes. Polymorphic markers, and respective map positions, of the present invention are provided in U.S. application Ser. No. 11/504,538, which is incorporated herein by reference in its entirety.

In yet another aspect, haplotype effect estimates are coupled with haplotype frequency values to calculate a haplotype breeding value of a specific haplotype relative to other haplotypes at the same haplotype window, or across haplotype windows, for one or more phenotypic traits. In other words, the change in population mean by fixing the haplotype is determined. In still another aspect, in the context of evaluating the effect of substituting a specific region in the genome, either by introgression or a transgenic event, haplotype breeding values are used as a basis in comparing haplotypes for substitution effects. Further, in hybrid crops, the breeding value of haplotypes is calculated in the context of at least one haplotype in a tester used to produce a hybrid. Once the value of haplotypes at a given haplotype window are determined and high density fingerprinting information is available on specific varieties or lines, selection can be applied to these genomic regions using at least one marker in the at least one haplotype.

In the present invention, selection can be applied at one or more stages of a breeding program:

a) Among genetically distinct populations, herein defined as "breeding populations," as a pre-selection method to increase the selection index and drive the frequency of favorable haplotypes among breeding populations, wherein pre-selection is defined as selection among populations based on at least one haplotype for use as parents in breeding crosses, and leveraging of marker-trait association identified in previous breeding crosses.

b) Among segregating progeny from a breeding population, to increase the frequency of the favorable haplotypes for the purpose of line or variety development.

c) Among segregating progeny from a breeding population, to increase the frequency of the favorable haplotypes prior to QTL mapping within this breeding population.

d) For hybrid crops, among parental lines from different heterotic groups to predict the performance potential of different hybrids.

In the present invention, it is contemplated that methods of determine associations between genotype and phenotype in haploid plants can be performed based on haplotypes, versus markers alone (Fan et al., 2006 Genetics). A haplotype is a segment of DNA in the genome of an organism that is assumed to be identical by descent for different individuals when the knowledge of identity by state at one or more loci is the same in the different individuals, and that the regional amount of linkage disequilibrium in the vicinity of that segment on the physical or genetic map is high. A haplotype can be tracked through populations and its statistical association with a given trait can be analyzed. By searching the target space for a QTL association across multiple QTL mapping populations that have parental lines with genomic regions that are identical by descent, the effective population size associated with QTL mapping is increased. The increased sample size results in more recombinant progeny which increases the precision of estimating the QTL position.

Thus, a haplotype association study allows one to define the frequency and the type of the ancestral carrier haplotype. An "association study" is a genetic experiment where one tests the level of departure from randomness between the segregation of alleles at one or more marker loci and the value of individual phenotype for one or more traits. Association studies can be done on quantitative or categorical traits, accounting or not for population structure and/or stratification. In the present invention, associations between haplotypes and phenotypes for the determination of "haplotype effect estimates" can be conducted de novo, using mapping populations for the evaluation of one or more phenotypes, or using historical genotype and phenotype data.

A haplotype analysis is important in that it increases the statistical power of an analysis involving individual biallelic markers. In a first stage of a haplotype frequency analysis, the frequency of the possible haplotypes based on various combinations of the identified biallelic markers of the invention is determined. The haplotype frequency is then compared for distinct populations and a reference population. In general, any method known in the art to test whether a trait and a genotype show a statistically significant correlation may be used.

Methods for determining the statistical significance of a correlation between a phenotype and a genotype, in this case a haplotype, may be determined by any statistical test known in the art and with any accepted threshold of statistical significance being required. The application of particular methods and thresholds of significance are well within the skill of the ordinary practitioner of the art.

To estimate the frequency of a haplotype, the base reference germplasm has to be defined (collection of elite inbred lines, population of random mating individuals, etc.) and a representative sample (or the entire population) has to be genotyped. For example, in one aspect, haplotype frequency is determined by simple counting if considering a set of inbred individuals. In another aspect, estimation methods that employ computing techniques like the Expectation/Maximization (EM) algorithm are required if individuals genotyped are heterozygous at more than one locus in the segment and linkage phase is unknown (Excoffier et al. 1995 Mol. Biol. Evol. 12: 921-927; Li et al., 2002 Biostatistics). Preferably, a method based on the EM algorithm (Dempster et al., 1977 J. R. Stat. Soc. Ser. B 39:1-38) leading to maximum-likelihood estimates of haplotype frequencies under the assumption of Hardy-Weinberg proportions (random mating) is used (Excoffier et al., 1995 Mol. Biol. Evol. 12: 921-927). Alternative approaches are known in the art that for association studies: genome-wide association studies, candidate region association studies and candidate gene association studies (Li et al., 2006 BMC Bioinformatics 7:258). The polymorphic markers of the present invention may be incorporated in any map of genetic markers of a plant genome in order to perform genome-wide association studies.

The present invention comprises methods to detect an association between at least one haplotype in a haploid crop plant and a preferred trait, including a transgene, or a multiple trait index and calculate a haplotype effect estimate based on this association. In one aspect, the calculated haplotype effect estimates are used to make decisions in a breeding program. In another aspect, the calculated haplotype effect estimates are used in conjunction with the frequency of the at least one haplotype to calculate a haplotype breeding value that will be used to make decisions in a breeding program. A multiple trait index (MTI) is a numerical entity that is calculated through the combination of single trait values in a formula. Most often calculated as a linear combination of traits or normalized derivations of traits, it can also be the result of more sophisticated calculations (for example, use of ratios between traits). This MTI is used in genetic analysis as if it were a trait.

Any given chromosome segment can be represented in a given population by a number of haplotypes that can vary from 1 (region is fixed), to the size of the population times the ploidy level of that species (2 in a diploid species), in a population in which every chromosome has a different haplotype. Identity-by-descent among haplotype carried by multiple individuals in a non-fixed population will result in an intermediate number of haplotype and possibly a differing frequency among the different haplotypes. New haplotypes may arise through recombination at meiosis between existing haplotypes in heterozygous progenitors. The frequency of each haplotype may be estimated by several means known to one versed in the art (e.g. by direct counting, or by using an EM algorithm). Let us assume that "k" different haplotypes, identified as "$h_i$" (i=1, . . . , k), are known, that their frequency in the population is "$f_i$" (i=1, . . . , k), and for each of these haplotypes we have an effect estimate "$Est_i$" (i=1, . . . , k). If we call the "haplotype breeding value" ($BV_i$) the effect on that population of fixing that haplotype, then this breeding value corresponds to the change in mean for the trait(s) of interest of that population between its original state of haplotype distribution at the window and a final state at which haplotype "$h_i$" encounters itself at a frequency of 100%. The haplotype breeding value of $h_i$ in this population is calculated as:

$$BV_i = Est_i - \sum_{i=1}^{k} Est_i f_i$$

One skilled in the art will recognize that haplotypes that are rare in the population in which effects are estimated tend to be less precisely estimated, this difference of confidence may lead to adjustment in the calculation. For example one can ignore the effects of rare haplotypes, by calculating breeding value of better known haplotype after adjusting the frequency of these (by dividing it by the sum of frequency of the better known haplotypes). One could also provide confidence intervals for the breeding value of each haplotypes.

The present invention anticipates that any particular haplotype breeding value will change according to the population for which it is calculated, as a function of difference of haplotype frequencies. The term "population" will thus assume different meanings, below are two examples of special cases. In one aspect, a population is a single inbred in which one intends to replace its current haplotype $h_j$ by a new haplotype $h_i$, in this case $BV_i=Est_i-Est_j$. In another aspect, a "population" is a F2 population in which the two parental haplotype $h_i$ and $h_j$ are originally present in equal frequency (50%), in which case $BV_i=½ (Est_i-Est_j)$.

These statistical approaches enable haplotype effect estimates to inform breeding decisions in multiple contexts. Other statistical approaches to calculate breeding values are known to those skilled in the art and can be used in substitution without departing from the spirit and scope of this invention.

In cases where conserved genetic segments, or haplotype windows, are coincident with segments in which QTL have been identified it is possible to deduce with high probability that QTL inferences can be extrapolated to other germplasm having an identical haplotype in that haplotype window. This a priori information provides the basis to select for favorable QTLs prior to QTL mapping within a given population. For example, plant breeding decisions could comprise:

a) Selection among haploid breeding populations to determine which populations have the highest frequency of favorable haplotypes, wherein haplotypes are designated as favorable based on coincidence with previous QTL mapping and preferred populations undergo doubling; or b) Selection of haploid progeny containing the favorable haplotypes in breeding populations prior to, or in substitution for, QTL mapping within that population, wherein selection could be done at any stage of breeding and at any generation of a selection and can be followed by doubling; or c) Prediction of progeny performance for specific breeding crosses; or d) Selection of haploid plants for doubling for subsequent use in germplasm improvement activities based on the favorable haplotypes, including line development, hybrid development, selection among transgenic events based on the breeding value of the haplotype that the transgene was inserted into, making breeding crosses, testing and advancing a plant through self fertilization, using plant or parts thereof for transformation, using plants or parts thereof for candidates for expression constructs, and using plant or parts thereof for mutagenesis.

In cases where haplotype windows are coincident with segments in which genes have been identified it is possible to deduce with high probability that gene inferences can be extrapolated to other germplasm having an identical genotype, or haplotype, in that haplotype window. This a priori information provides the basis to select for favorable genes or gene alleles on the basis of haplotype identification within a given population. For example, plant breeding decisions could comprise:

a) Selection among haploid breeding populations to determine which populations have the highest frequency of favorable haplotypes, wherein haplotypes are designated as favorable based on coincidence with previous gene mapping and preferred populations undergo doubling; or b) Selection of haploid progeny containing the favorable haplotypes in breeding populations, wherein selection is effectively enabled at the gene level, wherein selection could be done at any stage of breeding and at any generation of a selection and can be followed by doubling; or c) Prediction of progeny performance for specific breeding crosses; or d) Selection of haploid plants for doubling for subsequent use in germplasm improvement activities based on the favorable haplotypes, including line development, hybrid development, selection among transgenic events based on the breeding value of the haplotype that the transgene was inserted into, making breeding crosses, testing and advancing a plant through self fertilization, using plant or parts thereof for transformation, using plants or parts thereof for candidates for expression constructs, and using plant or parts thereof for mutagenesis.

A preferred haplotype provides a preferred property to a parent plant and to the progeny of the parent when selected by a marker means or phenotypic means. The method of the present invention provides for selection of preferred haplotypes, or haplotypes of interest, and the accumulation of these haplotypes in a breeding population.

In the present invention, haplotypes and associations of haplotypes to one or more phenotypic traits provide the basis for making breeding decisions and germplasm improvement activities. Non-limiting examples of breeding decisions include progeny selection, parent selection, and recurrent selection for at least one haplotype. In another aspect, breeding decisions relating to development of plants for commercial release comprise advancing plants for testing, advancing plants for purity, purification of sublines during development, inbred development, variety development, and hybrid development. In yet other aspects, breeding decisions and germplasm improvement activities comprise transgenic event selection, making breeding crosses, testing and advancing a plant through self-fertilization, using plants or parts thereof for transformation, using plants or parts thereof for candidates for expression constructs, and using plants or parts thereof for mutagenesis.

In another embodiment, this invention enables indirect selection through selection decisions for at least one phenotype based on at least one numerical value that is correlated, either positively or negatively, with one or more other phenotypic traits. For example, a selection decision for any given haplotype effectively results in selection for multiple phenotypic traits that are associated with the haplotype.

In still another embodiment, the present invention acknowledges that preferred haplotypes identified by the methods presented herein may be advanced as candidate genes for inclusion in expression constructs, i.e., transgenes. Nucleic acids underlying haplotypes of interest may be expressed in plant cells by operably linking them to a promoter functional in plants. In another aspect, nucleic acids underlying haplotypes of interest may have their expression modified by double-stranded RNA-mediated gene suppression, also known as RNA interference ("RNAi"), which includes suppression mediated by small interfering RNAs ("siRNA"), trans-acting small interfering RNAs ("tasiRNA"), or microRNAs ("miRNA"). Examples of RNAi methodology suitable for use in plants are described in detail in U.S. Patent Application Publications 2006/0200878 and 2007/0011775.

Methods are known in the art for assembling and introducing constructs into a cell in such a manner that the nucleic acid molecule for a trait is transcribed into a functional mRNA molecule that is translated and expressed as a protein product. For the practice of the present invention, conventional compositions and methods for preparing and using constructs and host cells are well known to one skilled in the art, see for example, Molecular Cloning: A Laboratory Manual, 3rd Edition Volumes 1, 2, and 3 (2000) J. F. Sambrook, D. W. Russell, and N. Irwin, Cold Spring Harbor Laboratory Press. Methods for making transformation constructs particularly suited to plant transformation include, without limitation, those described in U.S. Pat. Nos. 4,971,908, 4,940,835, 4,769,061 and 4,757,011, all of which are herein incorporated by reference in their entirety. Transformation methods for the introduction of expression units into plants are known in the art and include electroporation as illustrated in U.S. Pat. No. 5,384,253; microprojectile bombardment as illustrated in U.S. Pat. Nos. 5,015,580; 5,550,318; 5,538,880; 6,160,208; 6,399,861; and 6,403,865; protoplast transformation as illustrated in U.S. Pat. No. 5,508,184; and Agrobacterium-mediated transformation as illustrated in U.S. Pat. Nos. 5,635,055; 5,824,877; 5,591,616; 5,981,840; and 6,384,301.

Another preferred embodiment of the present invention is to build additional value by selecting a composition of haplotypes wherein each haplotype has a haplotype effect estimate that is not negative with respect to yield, or is not positive with respect to maturity, or is null with respect to maturity, or amongst the best 50 percent with respect to a phenotypic trait, transgene, and/or a multiple trait index when compared to any other haplotype at the same chromosome segment in a set of germplasm, or amongst the best 50 percent with respect to a phenotypic trait, transgene, and/or a multiple trait index when compared to any other haplotype across the entire genome in a set of germplasm, or the haplotype being present with a frequency of 75 percent or more in a breeding population or a set of germplasm provides evidence of its high value, or any combination of these.

This invention anticipates a stacking of haplotypes from multiple windows into plants or lines by crossing parent plants or lines containing different haplotype regions. The value of the plant or line comprising in its genome stacked haplotype regions is estimated by a composite breeding value, which depends on a combination of the value of the traits and the value of the haplotype(s) to which the traits are linked. The present invention further anticipates that the composite breeding value of a plant or line is improved by modifying the components of one or each of the haplotypes. Additionally, the present invention anticipates that additional value can be built into the composite breeding value of a plant or line by selection of at least one recipient haplotype with a preferred haplotype effect estimate or, in conjunction with the haplotype frequency, breeding value to which one or any of the other haplotypes are linked, or by selection of plants or lines for stacking haplotypes by breeding.

Another embodiment of this invention is a method for enhancing breeding populations by accumulation of one or more preferred haplotypes in a set of germplasm. Genomic regions defined as haplotype windows include genetic information that contribute to one or more phenotypic traits of the plant. Variations in the genetic information at one or more loci can result in variation of one or more phenotypic traits, wherein the value of the phenotype can be measured. The genetic mapping of the haplotype windows allows for a determination of linkage across haplotypes. A haplotype of interest has a DNA sequence that is novel in the genome of the progeny plant and can in itself serve as a genetic marker for the haplotype of interest. Notably, this marker can also be used as an identifier for a gene or QTL. For example, in the event of multiple traits or trait effects associated with the haplotype, only one marker would be necessary for selection purposes. Additionally, the haplotype of interest may provide a means to select for plants that have the linked haplotype region. Selection can be performed by screening for tolerance to an applied phytotoxic chemical, such as an herbicide or antibiotic, or to pathogen resistance. Selection may be performed using phenotypic selection means, such as, a morphological phenotype that is easy to observe such as seed color, seed germination characteristic, seedling growth characteristic, leaf appearance, plant architecture, plant height, and flower and fruit morphology.

The present invention also provides for the screening of progeny haploid plants for haplotypes of interest and using haplotype effect estimates as the basis for selection for use in a breeding program to enhance the accumulation of preferred haplotypes. The method includes: a) providing a breeding population comprising at least two haploid plants wherein the genome of the breeding population comprises a plurality of haplotype windows and each of the plurality of haplotype windows comprises at least one haplotype; and b) associating a haplotype effect estimate for one or more traits for two or more haplotypes from one or more of the plurality of haplotype windows, wherein the haplotype effect estimate can then be used to calculate a breeding value that is a function of the estimated effect for any given phenotypic trait and the frequency of each of the at least two haplotypes; and c) ranking one or more of the haplotypes on the basis of a value, wherein the value is a haplotype effect estimate, a haplotype frequency, or a breeding value and wherein the value is the basis for determining whether a haplotype is a preferred haplotype, or haplotype of interest; and d) utilizing the ranking as the basis for decision-making in a breeding program; and e) at least one progeny haploid plant is selected for doubling on the basis of the presence of the respective markers associated with the haplotypes of interest, wherein the progeny haploid plant comprises in its genome at least a portion of the haplotype or haplotypes of interest of the first plant and at least one preferred haplotype of the second plant; and f) using resulting doubled haploid plants in activities related to germplasm improvement wherein the activities are selected from the group consisting of line and variety development, hybrid development, transgenic event selection, making breeding crosses, testing and advancing a plant through self fertilization, using plant or parts thereof for transformation, using plants or parts thereof for candidates for expression constructs, and using plant or parts thereof for mutagenesis.

Using this method, the present invention contemplates that haplotypes of interest are selected from a large population of plants, and the selected haplotypes can have a synergistic breeding value in the germplasm of a crop plant. Additionally, this invention provides for using the selected haplotypes in the described breeding methods to accumulate other beneficial and preferred haplotype regions and to be maintained in a breeding population to enhance the overall germplasm of the crop plant.

Plant Breeding

Plants of the present invention can be part of or generated from a breeding program. The choice of breeding method depends on the mode of plant reproduction, the heritability of the trait(s) being improved, and the type of cultivar used commercially (e.g., $F_1$ hybrid cultivar, pureline cultivar, etc). A cultivar is a race or variety of a plant species that has been created or selected intentionally and maintained through cultivation.

Selected, non-limiting approaches for breeding the plants of the present invention are set forth below. A breeding program can be enhanced using marker assisted selection (MAS) on the progeny of any cross. It is understood that nucleic acid markers of the present invention can be used in a MAS (breeding) program. It is further understood that any commercial and non-commercial cultivars can be utilized in a breeding program. Factors such as, for example, emergence vigor, vegetative vigor, stress tolerance, disease resistance, branching, flowering, seed set, seed size, seed density, standability, and threshability etc. will generally dictate the choice.

Genotyping can be further economized by high throughput, non-destructive seed sampling. In one embodiment, plants can be screened for one or more markers, such as genetic markers, using high throughput, non-destructive seed sampling. In a preferred aspect, haploid seed is sampled in this manner and only seed with at least one marker genotype of interest is advanced for doubling. Apparatus and methods for the high-throughput, non-destructive sampling of seeds have been described which would overcome the obstacles of statistical samples by allowing for individual seed analysis. For example, U.S. patent application Ser. No. 11/213,430 (filed Aug. 26, 2005); U.S. patent application Ser. No. 11/213,431 (filed Aug. 26, 2005); U.S. patent application Ser. No. 11/213,432 (filed Aug. 26, 2005); U.S. patent application Ser. No. 11/213,434 (filed Aug. 26, 2005); and U.S. patent application Ser. No. 11/213,435 (filed Aug. 26, 2005), U.S. patent application Ser. No. 11/680,611 (filed Mar. 2, 2007), which are incorporated herein by reference in their entirety, disclose apparatus and systems for the automated sampling of seeds as well as methods of sampling, testing and bulking seeds.

For highly heritable traits, a choice of superior individual plants evaluated at a single location will be effective, whereas for traits with low heritability, selection should be based on mean values obtained from replicated evaluations of families of related plants. Popular selection methods commonly include pedigree selection, modified pedigree selection, mass selection, and recurrent selection. In a preferred aspect, a backcross or recurrent breeding program is undertaken.

The complexity of inheritance influences choice of the breeding method. Backcross breeding can be used to transfer one or a few favorable genes for a highly heritable trait into a desirable cultivar. This approach has been used extensively for breeding disease-resistant cultivars. Various recurrent selection techniques are used to improve quantitatively inherited traits controlled by numerous genes.

Breeding lines can be tested and compared to appropriate standards in environments representative of the commercial target area(s) for two or more generations. The best lines are candidates for new commercial cultivars; those still deficient in traits may be used as parents to produce new populations for further selection.

The development of new elite corn hybrids requires the development and selection of elite inbred lines, the crossing of these lines and selection of superior hybrid crosses. The hybrid seed can be produced by manual crosses between selected male-fertile parents or by using male sterility systems. Additional data on parental lines, as well as the phenotype of the hybrid, influence the breeder's decision whether to continue with the specific hybrid cross.

Pedigree breeding and recurrent selection breeding methods can be used to develop cultivars from breeding populations. Breeding programs combine desirable traits from two or more cultivars or various broad-based sources into breeding pools from which cultivars are developed by selfing and selection of desired phenotypes. New cultivars can be evaluated to determine which have commercial potential.

Backcross breeding has been used to transfer genes for a simply inherited, highly heritable trait into a desirable homozygous cultivar or inbred line, which is the recurrent parent. The source of the trait to be transferred is called the donor parent. After the initial cross, individuals possessing the phenotype of the donor parent are selected and repeatedly crossed (backcrossed) to the recurrent parent. The resulting plant is expected to have most attributes of the recurrent parent (e.g., cultivar) and, in addition, the desirable trait transferred from the donor parent.

The single-seed descent procedure in the strict sense refers to planting a segregating population, harvesting a sample of one seed per plant, and using the one-seed sample to plant the next generation. When the population has been advanced from the $F_2$ to the desired level of inbreeding, the plants from which lines are derived will each trace to different $F_2$ individuals. The number of plants in a population declines each generation due to failure of some seeds to germinate or some plants to produce at least one seed. As a result, not all of the $F_2$ plants originally sampled in the population will be represented by a progeny when generation advance is completed.

Descriptions of other breeding methods that are commonly used for different traits and crops can be found in one of several reference books (Allard, "Principles of Plant Breeding," John Wiley & Sons, NY, U. of CA, Davis, Calif., 50-98, 1960; Simmonds, "Principles of Crop Improvement," Longman, Inc., NY, 369-399, 1979; Sneep and Hendriksen, "Plant Breeding Perspectives," Wageningen (ed), Center for Agricultural Publishing and Documentation, 1979; Fehr, In: *Soybeans: Improvement, Production and Uses*, 2nd Edition, *Manograph.*, 16:249, 1987; Fehr, "Principles of Variety Development," *Theory and Technique*, (Vol. 1) and *Crop Species Soybean* (Vol. 2), Iowa State Univ., Macmillan Pub. Co., NY, 360-376, 1987).

An alternative to traditional QTL mapping involves achieving higher resolution by mapping haplotypes, versus individual markers (Fan et al., 2006 Genetics 172:663-686). This approach tracks blocks of DNA known as haplotypes, as defined by polymorphic markers, which are assumed to be identical by descent in the mapping population. This assumption results in a larger effective sample size, offering greater resolution of QTL. Methods for determining the statistical significance of a correlation between a phenotype and a genotype, in this case a haplotype, may be determined by any statistical test known in the art and with any accepted threshold of statistical significance being required. The application of particular methods and thresholds of significance are well with in the skill of the ordinary practitioner of the art.

It is further understood, that the present invention provides bacterial, viral, microbial, insect, mammalian and plant cells comprising the nucleic acid molecules of the present invention.

As used herein, a "nucleic acid molecule," be it a naturally occurring molecule or otherwise may be "substantially purified", if desired, referring to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

The agents of the present invention may be labeled with reagents that facilitate detection of the agent (e.g. fluorescent labels (Prober et al., 1987 Science 238:336-340; Albarella et al., European Patent 144914), chemical labels (Sheldon et al., U.S. Pat. No. 4,582,789; Albarella et al., U.S. Pat. No. 4,563,417), modified bases (Miyoshi et al., European Patent 119448).

Having now generally described the invention, the same will be more readily understood through reference to the following examples which are provided by way of illustration, and are not intended to be limiting of the present invention, unless specified.

EXAMPLES

Example 1

Phenotyping for GLS Reaction

In order to detect QTL associated with GLS resistance, plants were phenotyped to determine GLS reaction. The following rating scale was used for phenotypic rating for GLS was used in all studies. The percentage of leaf area infected is used to rate plants on a scale of 1 (very resistant) to 9 (susceptible). Disease resistance is evaluated visually after pollination. The infection can be natural or by artificial inoculation in the experiments.

TABLE 1

Description of rating scale used for GLS phenotyping.

| Description | Rating | Symptoms |
|---|---|---|
| Very Resistant | 1 | 0% of leaf area infected; no visible lesions |
| Very Resistant | 2 | ILA < 1%; few lesions, dispersed through lower leaves |
| Resistant | 3 | $1\% \leq ILA \leq 20\%$ |
| Resistant | 4 | $20\% \leq ILA \leq 40\%$ |
| Mid-resistant | 5 | $40\% \leq ILA \leq 50\%$; lesions reaching ear leaf, with spare lesions in the leaves above the ear |
| Mid-Susceptible | 6 | $50\% \leq ILA \leq 60\%$; lesions reaching the leaves above the ear |
| Susceptible | 7 | $60\% \leq ILA \leq 75\%$ |
| Susceptible | 8 | $75\% \leq ILA \leq 90\%$ |

TABLE 1-continued

Description of rating scale used for GLS phenotyping.

| Description | Rating | Symptoms |
| --- | --- | --- |
| Susceptible | 9 | >90% of foliar area infected, with premature death of the plant before forming black layer |

ILA = infected leaf area.

Example 2

GLS Resistance Mapping Study 1

To examine associations between SNP markers and GLS resistance in corn, analyzed data from a number of studies was combined. An association study was conducted to evaluate whether significant associations between one or more marker genotypes and GLS resistance are present in one or more breeding crosses. The mapping study combined data from 176 mapping populations. The number of individuals in each population ranged from 95 to 276. Segregating populations were of the following generations F2, BC1F2, BC 1, and DH. The number of SNP markers used for genotyping ranged from 55 to 158. Individuals were phenotyped for traits, including GLS resistance. A total of 2499 associations between SNP markers and GLS resistance were identified on Chromosomes 1, 2, 3, 4, 5, 6, 7, 8, 9, and 10. The SNP markers provided can be used to monitor the introgression of GLS resistance into a breeding population. SNP markers associated with GLS resistance, level of significance, and favorable alleles are reported in FIG. 1.

Example 3

GLS Resistance Mapping Study 2

An association study was conducted to evaluate whether significant associations between one or more marker genotypes and GLS resistance are present in one or more breeding crosses. In the association study, 769 F2s from the CV128/CV162 population were screened with 117 markers. A total of 53 associations between SNP markers and GLS resistance were identified on Chromosomes 1, 2, 3, 4, 5, 6, and 8. The SNP markers provided can be used to monitor the introgression of GLS resistance into a breeding population. SNP markers associated with GLS resistance, level of significance, and favorable alleles are reported in FIG. 1.

Example 4

GLS Resistance Mapping Study 3

An association study was conducted to evaluate whether significant associations between one or marker genotypes and GLS resistance are present in one or more populations. In the association study, 1177 inbred corn lines were screened with 1051 SNP markers. A total of 92 significant associations between SNP markers and GLS resistance were identified on Chromosomes 5, 6, 7, 8, 9, and 10. The SNP markers provided can be used to monitor the introgression of GLS resistance into a breeding population. SNP markers associated with GLS resistance, level of significance, and favorable alleles are reported in FIG. 1.

Example 5

GLS Resistance Mapping Study 4

An association study was conducted to evaluate whether significant associations between one or marker genotypes and GLS resistance are present in one or more populations. In this association study, 1036 DH lines from 398 F1 families were screened with 2,136 SNP markers. A total of 205 significant associations between SNP markers and GLS resistance were identified on Chromosomes 1, 2, 3, 4, 5, 6, 7, 8, 8, and 10. The SNP markers provided can be used to monitor the introgression of GLS resistance into a breeding population. SNP markers associated with GLS resistance, level of significance, and favorable alleles are reported in FIG. 1.

Example 6

GLS Resistance Mapping Study 5

An association study was conducted to evaluate whether significant associations between one or more marker genotypes and GLS resistance are present in one or more populations. In this association study, 495 Single seed descent (SSD) lines from 495 F1 families were screened with 1958 SNP markers. A total of 309 significant associations between SNP markers and GLS resistance were identified on Chromosomes 1, 2, 3, 4, 5, 6, 7, 8, 9, and 10. The SNP markers provided can be used to monitor the introgression of GLS resistance into a breeding population. SNP markers associated with GLS resistance, level of significance, and favorable alleles are reported in FIG. 1.

From the association studies of Examples 2 through 6, 1227 SNP markers were found to be associated with GLS. QTL were assigned by dividing maize chromosomal regions into 10 cM windows. A total of 176 QTL were identified by associating SNP markers with GLS resistance. The favorable alleles used for selecting for GLS resistance are also provided in FIG. 1. Selection for GLS resistance is based on the genotype of GLS resistant parent.

Example 7

Exemplary Marker Assays for Detecting GLS Resistance

In one embodiment, the detection of polymorphic sites in a sample of DNA, RNA, or cDNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis, fluorescence detection methods, or other means. Exemplary primers and probes for amplifying and detecting genomic regions associated with GLS resistance are given in Table 2.

TABLE 2

Exemplary assays for detecting GLS resistance.

| Marker | Marker SEQ ID | SNP Position | SEQ ID Forward Primer | SEQ ID Reverse Primer | SEQ ID Probe 1 | SEQ ID Probe 2 |
| --- | --- | --- | --- | --- | --- | --- |
| NC0199588 | 1219 | 137 | 1304 | 1305 | 1306 | 1307 |
| NC0055894 | 421 | 202 | 1308 | 1309 | 1310 | 1311 |

TABLE 2-continued

Exemplary assays for detecting GLS resistance.

| Marker | Marker SEQ ID | SNP Position | SEQ ID Forward Primer | SEQ ID Reverse Primer | SEQ ID Probe 1 | SEQ ID Probe 2 |
|---|---|---|---|---|---|---|
| NC0028145 | 481 | 307 | 1312 | 1313 | 1314 | 1315 |
| NC0003425 | 1127 | 280 | 1316 | 1317 | 1318 | 1319 |

Example 8

Oligonucleotide Hybridization Probes Useful for Detecting Corn Plants with GLS Resistance Loci Oligonucleotides can also be used to detect or type the polymorphisms associated with GLS resistance disclosed herein by hybridization-based SNP detection methods. Oligonucleotides capable of hybridizing to isolated nucleic acid sequences which include the polymorphism are provided. It is within the skill of the art to design assays with experimentally determined stringency to discriminate between the allelic state of the polymorphisms presented herein. Exemplary assays include Southern blots, Northern blots, microarrays, in situ hybridization, and other methods of polymorphism detection based on hybridization. Exemplary oligonucleotides for use in hybridization-based SNP detection are provided in Table 3. These oligonucleotides can be detectably labeled with radioactive labels, fluorophores, or other chemiluminescent means to facilitate detection of hybridization to samples of genomic or amplified nucleic acids derived from one or more corn plants using methods known in the art.

TABLE 3

Exemplary Oligonucleotide Hybridization Probes*.

| Marker | SEQ ID Marker | SNP Position | Hybridization Probe | SEQ ID Probe |
|---|---|---|---|---|
| NC0199588 | 1219 | 137 | CAGCGCAGGGCTAGCT | 1320 |
| NC0199588 | 1219 | 137 | CAGCGCAGAGCTAGCT | 1321 |
| NC0055894 | 421 | 202 | CCCAGTCGCAGTCCTA | 1322 |
| NC0055894 | 421 | 202 | CCCAGTCGTAGTCCTA | 1323 |
| NC0028145 | 481 | 307 | ACAGCAACAAACCCAA | 1324 |
| NC0028145 | 481 | 307 | ACAGCAACGAACCCAA | 1325 |
| NC0003425 | 1127 | 280 | ATGTGCCTGGTACCAG | 1326 |
| NC0003425 | 1127 | 280 | ATGTGCCTCGTACCAG | 1327 |

*SNP nucleotides in bold.

Example 9

Oligonucleotide Probes Useful for Detecting Corn Plants with GLS Resistance Loci by Single Base Extension Methods Oligonucleotides can also be used to detect or type the polymorphisms associated with GLS resistance disclosed herein by single base extension (SBE)-based SNP detection methods. Exemplary oligonucleotides for use in SBE-based SNP detection are provided in Table 4. SBE methods are based on extension of a nucleotide primer that is hybridized to sequences immediately adjacent to a polymorphism to incorporate a detectable nucleotide residue upon extension of the primer. It is also anticipated that the SBE method can use three synthetic oligonucleotides. Two of the oligonucleotides serve as PCR primers and are complementary to the sequence of the locus which flanks a region containing the polymorphism to be assayed. Exemplary PCR primers that can be used to type certain polymorphisms disclosed in this invention are provided in Table 3 in the columns labeled "Forward Primer SEQ ID" and "Reverse Primer SEQ ID". Following amplification of the region containing the polymorphism, the PCR product is hybridized with an extension primer which anneals to the amplified DNA immediately adjacent to the polymorphism. DNA polymerase and two differentially labeled dideoxynucleoside triphosphates are then provided. If the polymorphism is present on the template, one of the labeled dideoxynucleoside triphosphates can be added to the primer in a single base chain extension. The allele present is then inferred by determining which of the two differential labels was added to the extension primer. Homozygous samples will result in only one of the two labeled bases being incorporated and thus only one of the two labels will be detected. Heterozygous samples have both alleles present, and will thus direct incorporation of both labels (into different molecules of the extension primer) and thus both labels will be detected.

TABLE 4

Probes (extension primers) for Single Base Extension (SBE) assays.

| Marker | Marker SEQ ID | SNP Position | Probe (SBE) | Probe SEQ ID |
|---|---|---|---|---|
| NC0199588 | 1219 | 137 | ATCGACGATCAGCGCAG | 1328 |
| NC0055894 | 421 | 202 | GACACGGTTCCCAGTCG | 1329 |
| NC0028145 | 481 | 307 | TACATATGCACAGCAAC | 1330 |
| NC0003425 | 1127 | 280 | ACATGTGACATGTGCCT | 1331 |

Example 10

Fine Mapping for GLS Resistance

Three populations were developed for associating marker genotypes and GLS resistance. GLS resistant donor lines CV174 and CV173 were each backcrossed three times to I294213 to create backcross mapping populations. An additional population was developed using CV171 as the resistant source. CV171 was backcrossed two times to I294213 and selfed one generation for fine mapping. Composite interval mapping was conducted. SNP markers associated with GLS resistance are provided in Table 5.

TABLE 5

SNP markers associated with GLS resistance.

| QTL | Marker | Chr | pos | LOD | Effect | Fav Parent | Favorable Allele | SNP Position | SEQ ID |
|---|---|---|---|---|---|---|---|---|---|
| 116 | NC0009667 | 6 | 139.1 | 6.966013 | 0.738745 | CV171 | G | 226 | 883 |
| 83 | NC0053636 | 6 | 136 | 6.896417 | 0.749228 | CV171 | A | 202 | 882 |
| 117 | NC0032368 | 6 | 144.3 | 6.226523 | 0.709636 | CV171 | G | 801 | 1360 |
| 116 | NC0002782 | 6 | 133.5 | 6.194592 | 0.858607 | CV171 | C | 121 | 881 |
| 38 | NC0108013 | 2 | 115.3 | 5.835505 | 0.734241 | CV171 | C | 340 | 306 |
| 37 | NC0151288 | 2 | 107.6 | 5.69125 | 0.868826 | CV171 | A | 1001 | 303 |
| 115 | NC0003201 | 6 | 127.9 | 3.889942 | 0.780583 | CV171 | G | 74 | 875 |
| 38 | NC0035094 | 2 | 116.9 | 6.76 | 0.666924 | CV174 | G | 173 | 310 |
| 77 | NC0002474 | 4 | 93.6 | 6.02 | 0.674649 | CV173 | C | 383 | 571 |
| 170 | NC0040011 | 10 | 54.2 | 2 | 0.503823 | CV173 | A | 598 | 1361 |
| 65 | NC0009079 | 3 | 194.2 | 1.82 | 0.443853 | CV173 | C | 118 | 484 |
| 82 | NC0038447 | 4 | 141.8 | 1.79 | 0.651293 | CV173 | A | 526 | 618 |
| 89 | NC0105613 | 5 | 16.6 | 1.59 | 0.375097 | CV173 | G | 178 | 667 |
| 29 | NC0107911 | 2 | 99.2 | 1.51 | 0.396756 | CV173 | T | 384 | 289 |
| 7 | NC0009159 | 1 | 66 | 1.49 | 0.423507 | CV173 | A | 360 | 56 |
| 128 | NC0015161 | 7 | 106.4 | 0.64 | 0.253679 | CV173 | G | 428 | 962 |
| 156 | NC0055759 | 9 | 62.1 | 0.54 | 0.287342 | CV173 | G | 149 | 1100 |
| 148 | NC0008757 | 8 | 156.3 | 0.16 | 0.312206 | CV173 | C | 274 | 1075 |

Example 11

Haploid Mapping Study for GLS Resistance with I133314/I206447 Population

The utility of haploid plants in genetic mapping of traits of interest is demonstrated in the following example. A haploid population was developed by crossing the inbred corn lines I133314 by I206447 and then inducing the resulting F1 hybrid to produce 1945 haploid plants. For mapping, 82 SNP markers were used to screen the haploid population. Phenotypic data relating to GLS reaction were collected on the population. Composite interval mapping was conducted to examine significant associations between GLS and the SNP markers. Table 6 provides the significant marker associations found in this study. QTL associated with GLS resistance were identified by genetic mapping with haploid plants. The source of the favorable allele for GLS resistance was I206447 for all markers except NC0151453 (SEQ ID NO: 1231) in which the source of the favorable allele was I133314. The chromosome (Chr.) location, chromosome position (Chr. pos), and favorable allele are provided for each marker in Table 6.

It is appreciated by one skilled in the art that haploid plants can be generated from any generation of plant population and that the methods of the present invention can be used with one or more individuals, including SSD, from any generation of plant population. Non-limiting examples of plant populations include F1, F2, BC 1, BC2F1, F3:F4, F2:F3, and so on, including subsequent filial generations, as well as experimental populations such as RILs and NILs. It is further anticipated that the degree of segregation within the one or more plant populations of the present invention can vary depending on the nature of the trait and germplasm under evaluation.

TABLE 6

Markers useful for detecting QTL associated with GLS in the I133314/I206447 haploid mapping population.

| Marker | Chr. | Chr. position | GLS QTL | LOD | Effect | Favorable Allele | SEQ ID Marker | SNP Position* |
|---|---|---|---|---|---|---|---|---|
| NC0147103 | 1 | 39.1 | 177 | 6.15 | 0.17 | C | 1228 | 1001 |
| NC0202383 | 2 | 19 | 2 | 20.38 | 0.30 | T | 1229 | 34 |
| NC0201657 | 2 | 179.2 | 178 | 26.30 | 0.34 | T | 1230 | 342 |
| NC0055894 | 3 | 112.4 | 57 | 6.74 | 0.17 | T | 421 | 202 |
| NC0151453 | 6 | 75.1 | 110 | 17.17 | -0.28 | T | 1231 | 119 |

*SNP position: refers to position of the SNP polymorphism in the indicated SEQ ID NO.

Example 12

Haploid Mapping Study for GLS Resistance with I294213/I283669 Population

The utility of haploid plants in genetic mapping of traits of interest is demonstrated in the following example. A haploid mapping population was developed by crossing the inbred corn lines I294213 by I283669. The resulting F1 hybrid was induced to produce 1895 haploid seed. For mapping, 82 SNP markers were used to screen the haploid population. Composite interval mapping was conducted to examine significant associations between GLS and the SNP markers. Table 8 provides the significant marker associations found in this study. QTL associated with GLS resistance were identified by genetic mapping with haploid plants. The source of the favorable alleles was I283669 for all makers except NC0003425 (SEQ ID NO: 1127) in which the source of the favorable allele was I294213. The chromosome (Chr.) location, chromosome position (Chr. pos), and favorable allele are provided for each marker in Table 7.

It is appreciated by one skilled in the art that the methods of the present invention can be used with one or more individuals, including SSD, from any generation of plant population.

Non-limiting examples of plant populations include to F1, F2, BC 1, BC2F1, F3:F4, F2:F3, and so on, including subsequent filial generations, as well as experimental populations such as RILs and NILs. It is further anticipated that the degree of segregation within the one or more plant populations of the present invention can vary depending on the nature of the trait and germplasm under evaluation.

Alternatively, a forward breeding approach is employed wherein one or more GLS resistance loci can be monitored for successful introgression following a cross with a susceptible parent with subsequent generations genotyped for one or more GLS resistance loci and for one or more additional traits of interest, including transgenic and nontransgenic traits.

TABLE 7

Markers useful for detecting QTL associated with GLS resistance in the I294213/I283669 haploid mapping population.

| Marker | Chr | pos | GLS QTL | LOD | Effect | Favorable Allele | SEQ ID Marker | SNP Position |
|---|---|---|---|---|---|---|---|---|
| NC0052741 | 1 | 49.5 | 5 | 136.19 | 0.75 | G | 36 | 411 |
| NC0028145 | 3 | 187.5 | 64 | 3.19 | 0.10 | G | 481 | 307 |
| NC0143354 | 5 | 1.8 | 88 | 8.33 | 0.16 | C | 659 | 303 |
| NC0040408 | 6 | 59.1 | 108 | 13.29 | 0.22 | T | 1232 | 336 |
| NC0109097 | 7 | 93.8 | 127 | 5.93 | 0.13 | T | 1233 | 97 |
| NC0003425 | 9 | 84.5 | 158 | 20.30 | −0.25 | G | 1127 | 280 |
| NC0199588 | 10 | 99.9 | 173 | 15.36 | 0.23 | G | 1219 | 137 |

* SNP Position: refers to the position of the SNP polymorphism in the indicated SEQ ID NO.

Example 13

Introgression of GLS Resistance in Breeding

Given the description of the above-described GLS resistance loci, an illustrative example is presented for the utility of said GLS resistance loci in a corn breeding program and, more specifically, in the context of development of inbred lines. GLS resistant line CV171 is used as a donor source. Corn inbred CV009 is used as the recurrent parent. Table 8 provides exemplary SNP markers and favorable alleles for selecting GLS resistant lines. Exemplary SNP markers NC0019588, NC0037947, NC0088767, NC0059114, NC0003201, NC0060514, NC0002782, NC0053636, NC0009667, and NC0032368 (SEQ ID NOs: 858, 860, 862, 866, 875, 877, 881, 882, 883, and 1360) are used to monitor introgression of GLS resistance regions from Chromosome 6. A breeder selects for lines carrying the resistance allele for one or more of said SNP markers, representing one or more GLS resistance loci.

The introgression of one or more resistance loci is achieved via repeated backcrossing to a recurrent parent accompanied by selection to retain one or more GLS resistance loci from the donor parent using the above-described markers. This backcross procedure is implemented at any stage in line development and occurs in conjunction with breeding for superior agronomic characteristics or one or more traits of interest, including transgenic and nontransgenic traits.

TABLE 8

SNP markers useful for introgression of GLS resistance from inbred CV171

| Marker | Marker SEQ ID NO. | Chromosome | Favorable allele |
|---|---|---|---|
| NC0019588 | 858 | 6 | C |
| NC0037947 | 860 | 6 | G |
| NC0088767 | 862 | 6 | A |
| NC0059114 | 866 | 6 | T |
| NC0003201 | 875 | 6 | G |
| NC0060514 | 877 | 6 | CA |
| NC0002782 | 881 | 6 | C |
| NC0053636 | 882 | 6 | A |
| NC0009667 | 883 | 6 | G |
| NC0032368 | 1360 | 6 | G |

In view of the foregoing, it will be seen that the several advantages of the invention are achieved and attained.

The embodiments were chosen and described in order to best explain the principles of the invention and its practical application to thereby enable others skilled in the art to best utilize the invention in various embodiments and with various modifications as are suited to the particular use contemplated.

Various patent and non-patent publications are cited herein, the disclosures of each of which are, to the extent necessary, incorporated herein by reference in their entireties.

As various modifications could be made in the constructions and methods herein described and illustrated without departing from the scope of the invention, it is intended that all matter contained in the foregoing description or shown in the accompanying drawings shall be interpreted as illustrative rather than limiting. The breadth and scope of the present invention should not be limited by any of the above-described exemplary embodiments, but should be defined only in accordance with the following claims appended hereto and their equivalents.

SEQUENCE LISTING (1361 sequences)

SEQ ID NO: 1 - DNA, 731 bp, Zea mays
  misc_feature (225)..(225): n is a, c, g, or t
  unsure (1)..(731): unsure at all n locations
gcggctactagggcatgtcatgaccagacgtggtcagctcagtgagttgtgatcctgcaataactcaattggtgctctctagagttattggagaatatcaacttagattggattctctctttgttgttctactgtctttgcttagttaagcacttcagccatatgccattcgtaatgaaatagctttggatgttgcagaaaattttgattgacatagagagtccnattttgacctttgtaccactgctttaatttgaatgtggtacaaggagaaacataccaaagttcgaggtaagacactggatcatttgaactttctagcgttgtttagtttcatatttctgccatcatgcatacttaaattgtgaaatgtgtatatgtagttcttaacatatgttaagtagcatgtggttttagttttttaccctcttctaaattgggatatagtctttccgtacctttatgattgaggttatagcagttttttgtgctcaaattaacaaaaaagtatagaataaccacatgcttctattaaacctgcctttttctactttgcaacttaaattaattctcctaaaatgcatacatttgcattgttcaaaactataaatttgtcgattgttccactatttaagatacatttttagatactgtgattgatctcattaaaccatgttggtttctacaaccaacttaacagtcaaggaaaatttacattggtaccggacgca

SEQ ID NO: 2 - DNA, 720 bp, Zea mays
  misc_feature (224)..(224): n is a, c, g, or t
  misc_feature (576)..(581): n is a, c, g, or t
  misc_feature (608)..(613): n is a, c, g, or t
  misc_feature (630)..(633): n is a, c, g, or t
  misc_feature (642)..(648): n is a, c, g, or t
  misc_feature (650)..(650): n is a, c, g, or t
  misc_feature (680)..(683): n is a, c, g, or t
  misc_feature (685)..(687): n is a, c, g, or t
  misc_feature (689)..(694): n is a, c, g, or t
  misc_feature (698)..(698): n is a, c, g, or t
  misc_feature (700)..(719): n is a, c, g, or t
  unsure (1)..(720): unsure at all n locations
gttacatttactacatgtagaaaatcctttaggtaccttgagaaccataaccacaagctttgcatatgaatcaatggagaaatatgaaatgtgaggttgctgtggtgattgctgagatgatccaccaggagcaacgatctgctcggagactagagagtgtgtaacagcaagttcctgaacgattcaaaataagtatctgagtatgacaaagtgtactgcataanctggtacaaaggtagatccatcaccgtgagaatacggaagaagcgttcagagatatcatcccccttcagcagaccatcttgctgcaactgtgtgacaaaacgagtgtatgccgcatcactagcacttacatgattacacatctgacaccattcagaaaacaggactgccacctgtacatcgaacaatttaacagattaattaacagtccagcaaatagattcaaggtatagttgtgagaatggcttgagcaagaacagcaacaaaatacaggtaacaccaccattggaagactacaactatctcctagttgaactaacatgctaatatgtgaccacatcaccgcaatcatgnnnnnnaattctatgagtagaaaaaggaacatnnnnnntacaaacaaaatcgttnnnnatttatacnnnnnnntnctgatcccatacccaacaaattgaaaaatnnnntnnnannnnnnaganannnnnnnnnnnnnnnnnnnnc

SEQ ID NO: 3 - DNA, 699 bp, Zea mays
  misc_feature (1)..(2): n is a, c, g, or t
  misc_feature (6)..(13): n is a, c, g, or t
  misc_feature (548)..(548): n is a, c, g, or t
  misc_feature (554)..(554): n is a, c, g, or t
  misc_feature (644)..(649): n is a, c, g, or t
  misc_feature (664)..(665): n is a, c, g, or t
  misc_feature (667)..(667): n is a, c, g, or t
  misc_feature (671)..(671): n is a, c, g, or t
  misc_feature (675)..(676): n is a, c, g, or t
  misc_feature (678)..(678): n is a, c, g, or t
  misc_feature (680)..(687): n is a, c, g, or t
  misc_feature (691)..(691): n is a, c, g, or t
  misc_feature (693)..(694): n is a, c, g, or t
  misc_feature (696)..(697): n is a, c, g, or t
  unsure (1)..(699): unsure at all n locations
nngcgnnnnnnnncgtagcggccgcagggcgaggacgacatgggcggcggcggcgactggtcgacgacatcctcgtcgccgtagcgggggcggacgaggacctgcttgacgcccatgggtcgcggcgcctgcggcccctgcccctgctatttttttttggcgggccggagctcctctcctctcctgtggtgtggtgtggactctggtctggttccggcggcgtcgggcggggtgtgcccggacaaaaaagcggacgcggaggaggtggaggtgggcggtgtcgagttgggtggcgaccgagccacgcgaacgcgctgatcagatcacgcgcgcacgggacgcaaacaagtgcatccgcacggtgacggccgtcacggtggcaactggcaagccaagtccccttttgctgatgccctgcctgcgcacccaacacacacacacacactcgcgggcataccccctttcttttacatgcaaaaataaataaataaaagaacgtagggaacatgggctgcgtttcattgattgggtcgccgcaaccgcgtgancctcgncatcccgtgtcgcgggaaattaggggtgaatccattccagcgtgtccatcatgtcacactttcagacaacatgcgtcgcgtcctctctcnnnnnnagtactcctttcgtnncnaaantatnntncnnnnnnnngacncnntnnac

SEQ ID NO: 4 - DNA, 659 bp, Zea mays
  misc_feature (622)..(623): n is a, c, g, or t
  misc_feature (625)..(626): n is a, c, g, or t
  misc_feature (634)..(634): n is a, c, g, or t
  misc_feature (640)..(640): n is a, c, g, or t
  misc_feature (656)..(657): n is a, c, g, or t
  unsure (1)..(659): unsure at all n locations
gaactctttcttcatgacttagcatatctgatggtgaactagaacctctgtcttcaatgggggttgctggagcgcagctcttaggctttgcagaagcaatagaagaatgaagttcatcgagaaagcttgggttagttgttgaacttaagcaagacccttcctgttgacttgaagctgtcctcgactcggccggactccaagcaaacaaaggactggaaacatctttcccaatacgttgagcaggtaggtttttcgatagatcctgccttgaattcagatctttaacaaatcctccttgtgaaccatttttagattcatgttgactttctgaccaggaaacatgctgattctgatgagattccacgttaccacgtccacaactcacatgtgccactgtaggactccatagggctctactgctgtgatggtggtttgattcaccagagcatcctccctgtattccatcatggttcaagtctgtgtgcccatatgaactcccaggagattgaatgaaaacagaatgcttattctggcagtgtgcttggctattcacagtataagcatcctttggtggaaccgaactagttgacagcgacaagctatcatctggagagtacacacnntnnctttctgnaacagnatacttattatactgnnca

SEQ ID NO: 5 - DNA, 750 bp, Zea mays
  misc_feature (597)..(599): n is a, c, g, or t
  misc_feature (619)..(619): n is a, c, g, or t
  misc_feature (630)..(631): n is a, c, g, or t
  misc_feature (634)..(635): n is a, c, g, or t
  misc_feature (637)..(639): n is a, c, g, or t
  misc_feature (643)..(648): n is a, c, g, or t
  misc_feature (655)..(660): n is a, c, g, or t
  misc_feature (738)..(739): n is a, c, g, or t
  unsure (1)..(750): unsure at all n locations
ctgcagcacctgctggacgccgttcaatccttcaccggcctcaactggtatggtatggtatgccttcgggccttcgcgaggtttctgtttcggtttcgtttcctgtgtgatgtaaattcttgtattcctgctccggtcatcaacaggtgggcgactattgcgctgacgacgttgatgatccggctggcgactgtcccgctgctgatcaaccagatgaagtccatgatgaagttaaatgtaatgcgtctactttaccaccttcttttgctgcctaatcctttgtctttaagcgtgtttgttactggtccaggcattactgcatgagactatgggggtgcccaaacgcataggagttgtcaaatttgaacctaagctttttaaaattttcaaactcgaaaattgtgacactgctaaagcataaagatgctatggtcaggatttccccgccattctaactggacataggtctcccatcatctggctctgcttgggagtcgctactcactgcttcccctactaatacactgagtttggttaagcgaaagattacaatctttatgtgcaacttctagtgatctggatgctaaaaatttatgnnntgcttggcagagttcttagngcagttcccannctnntnnnactnnnnnnaaatctnnnnnnctgtactttacagaaaatgactctcagatgattatgtcaattgattatgatgattatgtcaattgattatctgaatgnnctctgcaacat

SEQ ID NO: 6 - DNA, 663 bp, Zea mays
  misc_feature (1)..(1): n is a, c, g, or t
  misc_feature (5)..(5): n is a, c, g, or t
  misc_feature (256)..(256): n is a, c, g, or t
  misc_feature (413)..(413): n is a, c, g, or t
  misc_feature (438)..(438): n is a, c, g, or t
  misc_feature (448)..(448): n is a, c, g, or t
  misc_feature (562)..(564): n is a, c, g, or t
  misc_feature (589)..(590): n is a, c, g, or t
  misc_feature (643)..(646): n is a, c, g, or t
  misc_feature (650)..(652): n is a, c, g, or t
  misc_feature (654)..(657): n is a, c, g, or t
  misc_feature (659)..(659): n is a, c, g, or t
  unsure (1)..(663): unsure at all n locations
ncagnaaaaatattcgatctccctgacgataaaaagaagcattctcacaatagcaactccacatgtttagtttcagtaattaattcatatggttgcttacttattattcacagtgcagaatgtgtaggatgggttcaggcttgtggtaaacttcaaaaaactagccctgcatcacaacttgcctaaatagcttagagtaactcttatggaaggtttacatagcaaccgttaaactatagacataactaacgtgtanagtcatcagtatacacacgagtacatgactaattgcttgtgttgctgtttacatacctcaaaacacagactaactgaaactattggttaagcttaatagaaggtaacggcctaatgaccagtaattaaatacatatctagcctaattttactgatanatcaagctggatgaatggatgatgncatgaaaggnaagtacgtacctgaagccaaggagatggaattccatagtaagtgtactcttgtggaatatcttgatttcttgctaacctctccaatattctcacacatttaggaagacaattcnnntatgcttcaacattgttggatactnntgaaacaaaaagactcgtgacagatgtcagcacacctaaatcacgctcatctnnnngttnnncnnnncngtca

SEQ ID NO: 7 - DNA, 433 bp, Zea mays
  misc_feature (3)..(3): n is a, c, g, or t
  misc_feature (6)..(6): n is a, c, g, or t
  misc_feature (129)..(129): n is a, c, g, or t
  misc_feature (287)..(287): n is a, c, g, or t
  misc_feature (333)..(333): n is a, c, g, or t
  misc_feature (343)..(343): n is a, c, g, or t
  misc_feature (365)..(365): n is a, c, g, or t
  unsure (1)..(433): unsure at all n locations
ccncanagggaggccaaaacaaagaaaagcagcaaacagcaatgcaatgaaattgcagccatacaaccactcttcgcgcaaagttagttgggtctgcgaggggatccatcttccccggcccttctctcncaatgtgccgccgagatctcgcaggaccactggactacatacaacttctggtcccacgagcaacacagcacagccacacacccatgtaaactctttgtactgtaaccataatctggacggggcgtcgcccttcagcaaaccaagttcctggaggcgtnaaaagttccgcaagcgacttctcgtctgccattcctgggatacccnactgaccaancaattagcgaagagatgcatgncttgtaccatgtgtcacacttgcataggtaaaccatagttctggaacgacctgatgtttccatcccaa

SEQ ID NO: 8 - DNA, 728 bp, Zea mays
  misc_feature (3)..(12): n is a, c, g, or t
  misc_feature (14)..(17): n is a, c, g, or t
  misc_feature (56)..(61): n is a, c, g, or t
  misc_feature (180)..(180): n is a, c, g, or t
  misc_feature (300)..(300): n is a, c, g, or t
  misc_feature (302)..(302): n is a, c, g, or t
  misc_feature (327)..(327): n is a, c, g, or t
  misc_feature (345)..(345): n is a, c, g, or t
  misc_feature (393)..(393): n is a, c, g, or t
  misc_feature (419)..(419): n is a, c, g, or t
  misc_feature (474)..(482): n is a, c, g, or t
  misc_feature (485)..(488): n is a, c, g, or t
  misc_feature (493)..(493): n is a, c, g, or t
  misc_feature (503)..(503): n is a, c, g, or t
  misc_feature (527)..(529): n is a, c, g, or t
  misc_feature (605)..(606): n is a, c, g, or t
  misc_feature (624)..(625): n is a, c, g, or t
  misc_feature (630)..(633): n is a, c, g, or t
  misc_feature (648)..(649): n is a, c, g, or t
  misc_feature (658)..(658): n is a, c, g, or t
  misc_feature (687)..(701): n is a, c, g, or t
  misc_feature (703)..(704): n is a, c, g, or t
  misc_feature (706)..(712): n is a, c, g, or t
  misc_feature (714)..(719): n is a, c, g, or t
  misc_feature (721)..(725): n is a, c, g, or t
  unsure (1)..(728): unsure at all n locations
ctnnnnnnnnnnannnntggactcctgcccggagtttgctaagaatcccactttgnnnnnngtgagaagcgcagaaaatgttagtttatgaccgcgagtccgcgccttgcttctgttcagctccacatatagataaactcgaaccttggctcatgcgtttattgattactatttcgtatntcgtaacatatcttgttatgctgttcttggaatcgaacttgcaacgaaacaatggcaatgtggaactgaagagtaatctaactaaagagcagctcaaggttgtagagtagaggcccatcnantgtcttccttttgcatgtaaaaccntttttttgttcccatccnatgcgctagaatttagatagaagacagagaagggttccacatcatcantttaactcaatatatgctgtatttgnctgttgtcttctatcgtcgagcgttactgcgtttttatatggtagcagaaaagtnnnnnnnnngannnnttgtncttactaggnttgtttttgtagtaacgtaaactnnnatgcacgatttgggaagaaggatccatggttacattgcctcatgcacccctttgctttagaacttgtggcactgtnnacaccttgtgtggggggnnggggnnnngcacctgccgcttgnncatatatanttctaactttgggagtaccatcaacctannnnnnnnnnnnnnnanngnnnnnnntnnnnnntnnnnnctc

SEQ ID NO: 9 - DNA, 717 bp, Zea mays
  misc_feature (221)..(221): n is a, c, g, or t
  misc_feature (301)..(301): n is a, c, g, or t
  misc_feature (338)..(338): n is a, c, g, or t
  misc_feature (344)..(344): n is a, c, g, or t
  misc_feature (377)..(377): n is a, c, g, or t
  misc_feature (400)..(400): n is a, c, g, or t
  misc_feature (413)..(413): n is a, c, g, or t
  misc_feature (426)..(426): n is a, c, g, or t
  misc_feature (440)..(446): n is a, c, g, or t
  misc_feature (493)..(493): n is a, c, g, or t
  misc_feature (556)..(556): n is a, c, g, or t
  misc_feature (571)..(571): n is a, c, g, or t
  misc_feature (573)..(573): n is a, c, g, or t
  misc_feature (594)..(598): n is a, c, g, or t
  misc_feature (601)..(607): n is a, c, g, or t
  misc_feature (621)..(621): n is a, c, g, or t
  misc_feature (633)..(633): n is a, c, g, or t
  misc_feature (635)..(635): n is a, c, g, or t
  misc_feature (637)..(643): n is a, c, g, or t
  misc_feature (647)..(647): n is a, c, g, or t
  misc_feature (654)..(660): n is a, c, g, or t
  misc_feature (664)..(664): n is a, c, g, or t
  misc_feature (666)..(674): n is a, c, g, or t
  misc_feature (678)..(686): n is a, c, g, or t
  misc_feature (690)..(690): n is a, c, g, or t
  misc_feature (695)..(698): n is a, c, g, or t
  misc_feature (704)..(716): n is a, c, g, or t
  unsure (1)..(717): unsure at all n locations
acctagtatccttcagcagtggcaatgacacaaacaaagtcagacaggtctaaaatacgcaaatacagaataagaaatttaatgccagcacaatcatagaacctgaatatcttaaaaagttcgtcgatctcagaatcgccagggaatagtggcttttggttcaccatttccgcaaagatacagcccacagaccacacatcaactggtgtggaatactgccncgctccaagcagaatttctggagctctgtaccataatgtcactacctgaaaaatacttccatagatatgtactgtgaatnaatgtgactagaatatacagcaaaaggttacgttatncgggtnaaaaattgtgggaatccataactttggcatccntcacaatattttttccctaacangacaattcaaacnccctttctcaagntagagcataacaannnnnnnatgtacctcatgagtaaatgtacggacaggaattccaaatgccctgnctaaaccaaagtccgcaagcttcagtgcattagtgcgccgatctatcaataagttttgaggtntcaagtctcgatgangnactctatgagaatggcagtannnnncannnnnnngtatctggtagagntatgactggagnangnnnnnnntagntacattnnnnnnngcancnnnnnnnnnctgnnnnnnnnncatnttcannnnatgagnnnnnnnnnnnnng

SEQ ID NO: 10 - DNA, 732 bp, Zea mays
  misc_feature (20)..(20): n is a, c, g, or t
  misc_feature (715)..(715): n is a, c, g, or t
  unsure (1)..(732): unsure at all n locations
acaaacacttcttgtattancgtgctcggttgattgaagagactggctgcgcgatgtattttatcttgacgtgtgtgaggctgaccacgttatcctatccaggaagtggctgtgcaagggcaagacaaggtgtacaaagatgtgatagagcctctcgagagtgtgagcgtcaactctattccaactagcaaggaggatatccgtgatcttggtcctccggataaggtttactattctcttttccataaataaacttggatagtccataggtatctagtggaaaaaggtccaattttgatgttttaactcctgtttgtcaggttgccgaggctctgattaaaaaagttttggcaccatcaacacaaaagacaaagttaattgaggcgaaagaggtgtgccttccgtccaattttccgtgcttggcctaactattcctgttaatattcttggacaccagtgcgtgtcaaatctttgaggatcaggcaatgatgatttgtgacatagcatggttctttaaataagttcattcacgcatgccgattggtttacgtggacagaattataaaagacggaatgagcttagttggtgctgattgacgaatctctctgagtccattttatttaggttgagcagtaagctgaacagctactctctgaaaatagcaaatgtactaatgaatggtttccacctacaacatgtattgagatttgttgnctggtttccaagtttca

SEQ ID NO: 11 - DNA, 680 bp, Zea mays
  misc_feature (65)..(65): n is a, c, g, or t
  misc_feature (247)..(247): n is a, c, g, or t
  misc_feature (298)..(298): n is a, c, g, or t
  misc_feature (330)..(330): n is a, c, g, or t
  misc_feature (365)..(365): n is a, c, g, or t
  misc_feature (399)..(399): n is a, c, g, or t
  unsure (1)..(680): unsure at all n locations
tggttcatcgctatggccttctcgagcgactcgtcgtcttgaaaatcgacatggcagaagccacnggaacccccggttcttttgtcgacggcaaaccttaccgatgcaatcttcgacggcccgaagaaacctcgcaagtcgttttcgtccacgttccatgagaggttgccaacatatgccgagaggcagccttcggacttcttggggtcggtttcgaactctgccttcctcttcttgtttgaggtgnccgtcaccctgcacctttcaaccctcatgtatctgctgccactgcacatcnatatacactagagtaagtatatcagtgaaaantggttttggagggcgtgcaaagagaactcaatgtncgcatgctagcacgcttacattttgaatccatcnagctcaagagactttattgcatcttcttctgactgcaatgatagaatcaaatgaaaaaacagatttgtcaaaagaaacagcagagattgcaaagatctagctttgcaagtttctccacccttgagctctctttacgctagataataaccgaattcatgtcccatgatcagtaataaaccatcacagatggaaatatgaaaacaggggttctggaatttataagctttgcagccttccaattcagacatcacatacatagacccttgctgcatagaaattca

SEQ ID NO: 12 - DNA, 680 bp, Zea mays; identical to SEQ ID NO: 11
  misc_feature (65)..(65): n is a, c, g, or t
  misc_feature (247)..(247): n is a, c, g, or t
  misc_feature (298)..(298): n is a, c, g, or t
  misc_feature (330)..(330): n is a, c, g, or t
  misc_feature (365)..(365): n is a, c, g, or t
  misc_feature (399)..(399): n is a, c, g, or t
  unsure (1)..(680): unsure at all n locations

SEQ ID NO: 13 - DNA, 646 bp, Zea mays
  misc_feature (1)..(5): n is a, c, g, or t
  misc_feature (7)..(8): n is a, c, g, or t
  unsure (1)..(646): unsure at all n locations
nnnnntnnactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggtggagtttctgctgctgtctccaagacagctgcagctccgattgagcgtgtcaagcttttgattcagaaccaggatgaaatgctcaagaccggcaggctttctgaaccgtacaagggtattggggactgctttggccggacaatcagagatgagggttttgtctcactgtggagaggaaacacagctaatgtcatccgttacttccccacacaggtgccacatgctatcccatccaaccattttttctggtgttatgtgattattattcatgctcatatgtttgcactagctaaacctaaattctccatcctgcttcaggcattgaactttgcgttcaaggatcacttcaagcgcatgttcaactttaagaaggacaaggatgggtact

SEQ ID NO: 14 - DNA, 1172 bp, Zea mays
  misc_feature (1)..(3): n is a, c, g, or t
  misc_feature (85)..(233): n is a, c, g, or t
  misc_feature (317)..(317): n is a, c, g, or t
  misc_feature (334)..(334): n is a, c, g, or t
  misc_feature (524)..(524): n is a, c, g, or t
  misc_feature (534)..(536): n is a, c, g, or t
  misc_feature (547)..(547): n is a, c, g, or t
  misc_feature (549)..(551): n is a, c, g, or t
  misc_feature (612)..(612): n is a, c, g, or t
  misc_feature (620)..(620): n is a, c, g, or t
  misc_feature (623)..(624): n is a, c, g, or t
  misc_feature (627)..(627): n is a, c, g, or t
  misc_feature (648)..(648): n is a, c, g, or t
  misc_feature (650)..(650): n is a, c, g, or t
  misc_feature (662)..(664): n is a, c, g, or t
  misc_feature (666)..(666): n is a, c, g, or t
  misc_feature (702)..(705): n is a, c, g, or t
  misc_feature (707)..(713): n is a, c, g, or t
  misc_feature (716)..(717): n is a, c, g, or t
  misc_feature (719)..(719): n is a, c, g, or t
  misc_feature (722)..(722): n is a, c, g, or t
  misc_feature (725)..(725): n is a, c, g, or t
  misc_feature (728)..(730): n is a, c, g, or t
  misc_feature (741)..(748): n is a, c, g, or t
  misc_feature (761)..(771): n is a, c, g, or t
  misc_feature (776)..(778): n is a, c, g, or t
  misc_feature (780)..(780): n is a, c, g, or t
  misc_feature (847)..(847): n is a, c, g, or t
  misc_feature (972)..(973): n is a, c, g, or t
  misc_feature (1048)..(1051): n is a, c, g, or t
  misc_feature (1080)..(1082): n is a, c, g, or t
  misc_feature (1092)..(1096): n is a, c, g, or t
  unsure (1)..(1172): unsure at all n locations
nnnctcaacaagctcagcgtcgaccgcaccctcgttgagatcttcgccgcgggcgttacgaaggacgacgttatcttgttcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatctggccgatgggagctggcaccgtgtcagcaagggtgcaccagaacaggtacgtagtcgtgcatggctttctcatgcatntcttcttttttttctgnattttctgttggattttcttccgagaccctgtgcatgcggatgcatgagatcagatggattttctgttggagcagccatgcattcggtgcccgagaatagacgagttttacgtttttctgttatttattttctgattttcaaaattcatttcctgagcttttttttaatgttactctcctatggcacgcngatactggcnnnctgcaactgtngnnncgacgtgtgcaacttggttcacactgtgatagacaaatatgccgagcgtggtcttcgatcncttgcggntgnnagncaggtatggttttatgactcncngagtttgcaagnnngntatggttatatgaatacattagataatgctttatcnnnntnnnnnnnagnnanttncgnagnnnagcaaagagannnnnnnngatccatgggaannnnnnnnnnngcttnnncngctggaccctccgaggtcggacagctccgacacaatcaagcgcgcgctcgacctcggtgtcaacgtnaagatgatcaccggtacgcctcgcattccgagaggtttctttcactcacgttgctatgttctgacaatggtcgcaacctgcttgcattgcaggtgaccagctcgccattgccaaggagaccgggnnacggctagggatgggcaccaacatgtacccgtcgtccgctctgctcgggcagagcaaagatgaagccaccgcttnnnnccccgtggacgacttgatcgagaaggccnnnggctttgctnnnnncttcccaggtagggaggagggagggggtttgcattgcaatgtgcatgaactgctataacaagtgcgttcttgatgc

SEQ ID NO: 15 - DNA, 788 bp, Zea mays
tgcatgcctgcagcagggaggaggaggaggaggcggctgcttctgcgccaccacgaagcccgagaatgtgatgagctgctcgctgctgctggtgctgcgaggacgaagagctggcgcggcgtgttcgccgccttgtgcgccgggccgcgccgacgccgactgcatctgcgcctgccgctttattcccggcccccggctgggctccaccgtcgtctccgcgtgacgaggtggatgacgaagcgtgcgcggaggcggagcacgagcgccggcagcggcagccatccccatggccgcttgcatcatgcgcatgtagctgttgtagccacctgctgctgctgttgcgagcgcccagcacaggccgccgctggcgctgggtggtgatggtgacccgtcgccctcacatgttcctgggcctgggcctcctcgcagcagcaccctcttggggctcgcgctcccatccatctcctcccgctcacgcctcctccccgcaccactgttgtttggctcctccattgcaaacacactacacggcaagcaaagcaacatgcatgcatgcatgcatggttggttcacaacttcttcacatcgtgccgtgtacgtgcaggagaaaattaaagttgctagtaaaactgacacgaaccaagttgatcaaagtagtttttatactaccaccacctttctcgaatattttgtagttcattttgaactaaaacatgacaaataaaaaaagaacggaccaaccaattagctagctggcatgcatttgtagaaagacattccatcaagat

SEQ ID NO: 16 - DNA, 696 bp, Zea mays
  misc_feature (8)..(10): n is a, c, g, or t
  misc_feature (118)..(118): n is a, c, g, or t
  misc_feature (121)..(121): n is a, c, g, or t
  misc_feature (133)..(133): n is a, c, g, or t
  misc_feature (145)..(145): n is a, c, g, or t
  misc_feature (212)..(217): n is a, c, g, or t
  misc_feature (238)..(238): n is a, c, g, or t
  misc_feature (258)..(284): n is a, c, g, or t
  misc_feature (316)..(316): n is a, c, g, or t
  unsure (1)..(696): unsure at all n locations
gcccgccnnncccgtctacctctggacgctccccatgttccactgcaacggctggaccttcacctggggcatggcggcgcgcggcggcgtcaacgtctgcatccgcgacgcgcgcccngcngacatctaccgngccatcgcgcgncaccgcgtcacccacatgtgctgcgcgcccgtcgtattcagcatcctcctcgacggcgacggcgacnnnnnnggcgccgccaggcagctccangcccccgtccacgtcctcannnnnnnnnnnnnnnnnnnnnnnnnnntgctcgagcgcgtcgagcggatcggcttcaangtcacgcacgcctacggcctcacggaggccacgggccccgcgctcgcgtgcgagtggcgcgaccagtgggaccgcctcccgctcccggagcgcgcgcgcctcaaggcgcgccagggggtcagcgtcctgtccctcgccgacgccgacgtcaagaacgccgacaccatgctcagcgtgccgcgcgacggcaggaccgtcggggagatcgtcctccggggcagcagcgtcatgaagggctacctcaacaacccggaggccaacgagagcgccttcagggccggctggttcctcaccggcgacgtcggcgtcgtgcacccggacggctacatcgagatcaaggaccgctccaaggacgtcatcatcagcggcggggagaacat

SEQ ID NO: 17 - DNA, 776 bp, Zea mays
  misc_feature (554)..(554): n is a, c, g, or t
  unsure (1)..(776): unsure at all n locations
gacttgctgggagtcaaaatgtctgtctggccgggcagggggtggaaacttggaggcgctgtcgtggagccggaggctcaagatcgccacgggcgcggcgcgcggcctcgccttcctgcactcgtcggagaaacaggtcatccacagggacttcaaggcgtccaacatcctcctcgactcggtaatcttcagcaaaagcaagcatgcgatatgaaggtcttctccttagctaccatgtccactaaccaaagacatgccaggatttcaccgcgaagctgtcggacttcgggctcgccaagaacgggccctccgcggggacgtcgcacgtcacgacccgggtcatggtcgcctacggctacgcggcgccggagtacgtcgccaccggtatgtaggttcctgcacccgcacgagcgtgacggcggtgatgatgcacggcgcggccaccaggcgcagccgccccacgtacgtacgttgacgccgtgcatgcagggcaactgtacgtcaagagcgacgtgtacggcttcagcgtggtgctgctggagctgctgacgggnctgcgcgcgcacgacctgaaccggccgacccaccagcacagcctggtggagtgggcgcggccttatctctccgccggcgccggcaagctcaagagcctcatggacgagcggatggacggccagtaccacaccaaggccgcgctctcggggtcgccaggctcgccggcaagtgcctcaacagcgaccgcaagagccgcccttccatggacgacgtcgtcgccg

SEQ ID NO: 18 - DNA, 485 bp, Zea mays
tggttggcctgcaccacggccatggagaactccccagtgacgagctgcccggcgtccttgtaccagaggagaccgtcctgccggccagcggcgtcggagccctttccccggtgcccggcacccgatcgcgggccccagcaggagctaaagtagtccatcaccgcggccagcatccctcatctcatcgccctcccctccacgcggtttcttgatggcatcctcgagggacccagctcgctcttatagcctttctctctccgccgccctttcagcctcttccttcctcccctgcttaacggaaacaacggatgcaaccaaatcaaagcgagctaaaaaaaaagtcaataatttgtgtgtgcgggtgagctggtggatcgtatcgtatgctgggatccaagaaaacttgcggccaactcatcatctcgtatgcatcaagcgtcgtccagtgtaggcggcagaaacatgtcaagggacaagaggcgaca

SEQ ID NO: 19 - DNA, 638 bp, Zea mays
tatgatccaaaggtggtaagtgcgccttcaaggatcggcgtggccatatcgctcaagccttgagatatgggtcaagtcaccttctgtaaaacagtacaagcgttacgtactgatactcgtgtccaagaacataaacttttggagcgatgcctagaacaaccctctcccttttagccttgtttttggtaagagccttgggcaaagaagtgttgtcagggagttggacttgttttgtggaatgtttccattaagagccaaccccacaccgatgattgcaaacagaggtttgtattagtgcagaagtttcactctgcgatattttttccccatgttttcctagtcgacgcaaaatgattttggaggtgattgaacacctaacgtcttgagttgacggcagctttaacagctctgattataaaggggccacttgtacccagcaacagaagaatttgctcccaattcgtcgaattggctattctggtggaacatttttttgttgtcgttggattggttcttttgaaattcatgtattcagagcagtctagttttgcttcctcgataaagtatgttgtgttggatatttgtgatgtgaggtgaatgcgcccaggctggagatcagccgatggaggcttatcgag

SEQ ID NO: 20 - DNA, 693 bp, Zea mays
  misc_feature (22)..(22): n is a, c, g, or t
  misc_feature (211)..(211): n is a, c, g, or t
  misc_feature (630)..(639): n is a, c, g, or t
  misc_feature (641)..(641): n is a, c, g, or t
  misc_feature (647)..(652): n is a, c, g, or t
  misc_feature (659)..(664): n is a, c, g, or t
  misc_feature (668)..(672): n is a, c, g, or t
  misc_feature (676)..(676): n is a, c, g, or t
  misc_feature (678)..(678): n is a, c, g, or t
  misc_feature (683)..(690): n is a, c, g, or t
  unsure (1)..(693): unsure at all n locations
tatcatggacacattttcattngtgtgcttatctcttatgcagtgccattgttatgtctgtgattgtcctgctccctgtgccctatgggacaagcattgtcatgctacggacaaggatagaaagtggaagagacttagggaaatatccaaaaataaaagccagccaaatcctaaacgaagaataccccagcatttcaaacgctcagtcacnacaggaccatcatcctcacagtattccgcaaatatgactggttttactggaagatttcctgcttcgggtactgcgaaccaaattcaacaggtggatatctctgttatggttgcacaggatatggtgaggggtatcagtctgccgagtgcaccatctcctacgccaagaactaaaaatcggagctatggatccaaaggtgcccagattgctcctccaatttatacattctcaaatgataatcatttccagccttctgttcctagctatggtctggtgcggcctcatgcatctaaaactgcacatgtttcatcaggaggtcatgttagcgctaagacttttcagagtaacccatctcagttttgtgttcgtgcaccaatgggatctcatggacacaggtaccgaccaccatcatatcctcnnnnnnnnnntnacacannnnnnggcactnnnnnncccnnnnnacgntncgccnnnnnnnncgc

SEQ ID NO: 21 - DNA, 523 bp, Zea mays
  misc_feature (35)..(36): n is a, c, g, or t
  misc_feature (373)..(373): n is a, c, g, or t
  misc_feature (384)..(385): n is a, c, g, or t
  misc_feature (416)..(416): n is a, c, g, or t
  misc_feature (462)..(467): n is a, c, g, or t
  misc_feature (471)..(471): n is a, c, g, or t
  unsure (1)..(523): unsure at all n locations
gtgcggtgcggccctcgcctctcctccagtcctcnnggcccttttgtttccttttttcttccctggctctcgtacgtgcttgctggagcgcgcttgatccggtttccttgcgcgcagttctcgttcctggcttccggccttggctggcctcctccccgcggaactgaggcgaattggcgcgggagggcacgggatcttgccgtcctgtcctggcgtctcctgccgcaccgcgtttgggcaacttttttttgtcggcgaaaaaagaatacatgaaaacgccgccttttgctcggggcgcttcacgggcctccgtgcgttttgaaaattctcttccgttccacctacactctttttcctcagctcgatctgcacnctcgttttttnnacttccgtttcgattgccccttcgccgctcngttctttgatttaataaagtgcgagtcctttatctctctttaactnnnnnntttnttctctctatcaggcagcattagccatggtttagcggaggcgattctcgttg

SEQ ID NO: 22 - DNA, 678 bp, Zea mays
  misc_feature (39)..(39): n is a, c, g, or t
  misc_feature (41)..(41): n is a, c, g, or t
  misc_feature (57)..(57): n is a, c, g, or t
  misc_feature (115)..(115): n is a, c, g, or t
  misc_feature (193)..(193): n is a, c, g, or t
  misc_feature (195)..(195): n is a, c, g, or t
  misc_feature (365)..(365): n is a, c, g, or t
  misc_feature (394)..(394): n is a, c, g, or t
  misc_feature (399)..(401): n is a, c, g, or t
  misc_feature (675)..(675): n is a, c, g, or t
  unsure (1)..(678): unsure at all n locations
cccgattcggtagttggcttggggatttcactgcaagtntngggattttctgtaggnaagttgatcgagaagtcttggtagacatggagcagatccagtactccgagaagtactncgacgacacctatgaatacaggtagatgcgaaaccctcgccttcacgatcttcacccttccacatcttttccgtcatngntggttggcaaaaccctatcgggatcccctttatccgcgcaggcacgtcgtcctcccgcccgaggtcgccaagctcctccccaggaacatccttctctccgaggtaaaacgcctgcagtttcacccgcattcctatagattgcgttctcgtcctgttgctttggttgtctnatgcctggcctttgtgggggatccccccnccccnnntctcctgtgcagaagcagtggcggttggtgggtgtgcagcagagccgcgggtgggtgcactacgcgatccaccggccggagccgcacatcatgctgttccgccgcccgatcaactaccagcagcagcaggaggaagcggctgccgcgcatgtgctgcccaagtgaagcctctgctggcgaccaggaatgttaaaaacccctagccctcttttcatctctaaaaggggcgtcgctgttgtgttgattaatccctctggctgttggttggaaactnggg

SEQ ID NO: 23 - DNA, 735 bp, Zea mays
  misc_feature (6)..(13): n is a, c, g, or t
  misc_feature (217)..(217): n is a, c, g, or t
  misc_feature (277)..(277): n is a, c, g, or t
  misc_feature (304)..(304): n is a, c, g, or t
  misc_feature (309)..(309): n is a, c, g, or t
  misc_feature (323)..(323): n is a, c, g, or t
  misc_feature (325)..(325): n is a, c, g, or t
  misc_feature (336)..(336): n is a, c, g, or t
  misc_feature (570)..(570): n is a, c, g, or t
  misc_feature (581)..(581): n is a, c, g, or t
  misc_feature (588)..(589): n is a, c, g, or t
  misc_feature (591)..(591): n is a, c, g, or t
  misc_feature (595)..(597): n is a, c, g, or t
  misc_feature (609)..(611): n is a, c, g, or t
  misc_feature (620)..(621): n is a, c, g, or t
  misc_feature (630)..(630): n is a, c, g, or t
  misc_feature (645)..(647): n is a, c, g, or t
  misc_feature (649)..(653): n is a, c, g, or t
  misc_feature (659)..(666): n is a, c, g, or t
  misc_feature (670)..(670): n is a, c, g, or t
  misc_feature (674)..(676): n is a, c, g, or t
  misc_feature (685)..(685): n is a, c, g, or t
  misc_feature (687)..(734): n is a, c, g, or t
  unsure (1)..(735): unsure at all n locations
agcggnnnnnnnnggatcggccgcagcagcagctgccgtcggttggtcggggaaccggaactcgctgccaaacccgcgggactgctggagtgtctgggcgaaggcctggtacttgcggatgtcggcgtcactcacgctgcgacgggcgtacttcatggactcctcgaagtgagcagccttgatctcagcgatgtcgtctacctcgtcttcctccatngcctcggggttgtctttcctgcgcctctccctctcgatatcctgaaatcaaatgtcccgnttagcaaacaggtatactactctacgnaaccnaatgctgcaaaaancngattatgggcnaagagattactacaccttctcgatgttctccctgatggcatacttgcacgcgcgctggcagatctctgtgatatctgcaccgctgaaaccctgggtgtatttggcgagagcattcaagtcaacatccttggccacaggagacttcctgagacaggctttgaagatctgaagcctggactgctcatcgggcagaggaatatagataagctgatcaagacgcccaggcctcagcanggctgggtcantgatgtnngntctnnnagttgcaccgannntaaaaaccnncttcttggnattcatgccatccannncnnnnngcagcnnnnnnnncacnctannngcagcaccncnnnnnnnnnnnnnnnnnnnnnnnnnnnnnnnnnnnnnnnnnnnnnnnnt

SEQ ID NO: 24 - DNA, 487 bp, Zea mays
  misc_feature (26)..(26): n is a, c, g, or t
  misc_feature (120)..(120): n is a, c, g, or t
  misc_feature (131)..(131): n is a, c, g, or t
  misc_feature (278)..(278): n is a, c, g, or t
  misc_feature (343)..(343): n is a, c, g, or t
  misc_feature (387)..(387): n is a, c, g, or t
  unsure (1)..(487): unsure at all n locations
ctccatttcatctattgcccctccanctaggcatattcttgtcaacctcacaactgtggctttgttcaactcccaattgccatcccttgcacgttttaaaaagtctcctactctgctggnctcctcctttntagagagaatctcaagactggcctccaaaatagtagagtttggcttaatctccaaggcaatcatttcctcaaacaccgttttggcatcgtctagcatgttcaaccgaacaaacccagtgatcaaagattcaaaagcttgaatacttngcgtaaacccggcgttctttgcagctacataccagctcatcatagcatggccacttccaagcagngaaaatgcacagatgaatgcatcatatgtagcggaattgggacngcaagcgtccatgctttccatagtctcgtataaggtcattgcagaaaggaggtctccggctgacaagaaagcatcgacaagggcattgcaaatgttagtg

SEQ ID NO: 25 - DNA, 660 bp, Zea mays
  misc_feature (99)..(99): n is a, c, g, or t
  misc_feature (101)..(102): n is a, c, g, or t
  misc_feature (104)..(105): n is a, c, g, or t
  misc_feature (108)..(108): n is a, c, g, or t
  misc_feature (111)..(112): n is a, c, g, or t
  misc_feature (114)..(115): n is a, c, g, or t
  misc_feature (240)..(240): n is a, c, g, or t
  misc_feature (254)..(254): n is a, c, g, or t
  misc_feature (265)..(265): n is a, c, g, or t
  misc_feature (267)..(275): n is a, c, g, or t
  misc_feature (277)..(279): n is a, c, g, or t
  misc_feature (656)..(656): n is a, c, g, or t
  unsure (1)..(660): unsure at all n locations
aggtggagttagctagctagctagctgttggtcagtgtgtgcggcgcgagagaggagaggactagcgcggtgctgtatttaaggcggctgaggacgctngnngnntgnggnngnngaagaagatgctgctggctggctgctgtaactgtaacaacaagacagtgaggagccaggtggcggtgctcgtctgcgactgcaacgctgacgacgggctttcaccgtgacgcgtcagacaaaatncatgccgtctctcntgtttcagacnannnnnnnnnannnaatacacaatgattcccgtctgttgcgcaatgcagtctacgagcttgacaggtcgtaccaatattgcttctgaatgacaggggagtaccttgcagataaagaaacattcaggacagtatgcagtgtaattatgcatgctaggaatatttcgaagctgtacaagatactctagcaagcaaagcacctacgagttattaggaagagacacaggatcacatagtgtcttatcttggcgattgtttttctctaatgacggcaccccggttgccttgtcgcatcggttgttaagtggtctaataatgacggcaccccggcggccgatgatttatattttaattaacttgtcgtaaacacaaatcgcagtttccacatactanacca

SEQ ID NO: 26 - DNA, 509 bp, Zea mays
  misc_feature (207)..(208): n is a, c, g, or t
  unsure (1)..(509): unsure at all n locations
aagacatgggctgtccgatggacagtaaagaacgacatcctccagcacttcataagcaaaatgatgtttctgagcacaagtcacagcagcttgatgacacattgaaacaccaaaagagctgtgatcatcctcaacctgtaggaagccctgagcaggatggaaaagactacaagaggcctaagcttgacggataggtttatatatatnngattttggatgggttttctggaagctgacaagcaatttggtgccggattcattgtatgatgacgtatacatgttgatgagcacgtgtcttcttcgctggtgcctgaagaagtgaagatgccgcgccacaaaattgctgtgctgcggagagcaccaagatgatgcgccccacaactgattgcagcttacagtttgaggaaagtcgggcagcaattattgttaggttccaacaaacattggaatataatatatatatgaacgaaacatgctgtcgcgcttctggtaacagggggatcctctag

SEQ ID NO: 27 - DNA, 645 bp, Zea mays
  misc_feature (1)..(7): n is a, c, g, or t
  misc_feature (16)..(18): n is a, c, g, or t
  misc_feature (38)..(38): n is a, c, g, or t
  misc_feature (194)..(194): n is a, c, g, or t
  misc_feature (524)..(524): n is a, c, g, or t
  misc_feature (563)..(568): n is a, c, g, or t
  misc_feature (579)..(579): n is a, c, g, or t
  misc_feature (581)..(610): n is a, c, g, or t
  misc_feature (613)..(617): n is a, c, g, or t
  misc_feature (630)..(635): n is a, c, g, or t
  misc_feature (637)..(639): n is a, c, g, or t
  misc_feature (641)..(641): n is a, c, g, or t
  misc_feature (644)..(644): n is a, c, g, or t
  unsure (1)..(645): unsure at all n locations
nnnnnnncctgacccnnnccctctcctcgcgcggggcncaccagctccgcgggggcttcctccgcctcccctccctcgcggcgctcccgaggctggcccacccctgccgccgccacgtctcggcgtccgctgcggcggcgcccaatggcgcctccgttgagggggagtacgactacgacctcttcaccatcggngccgggagcggcggcgtccgcgcgtcgcgcttcgcctccgcgctctacggctcgcgcgtcgccatctgcgagatgcccttcgccacgatcgcctcggacgagctcggtggcctcggcggcacgtaagtggatgcctctcttgttcatctactgtatttggcatgtactccgtgtatttttgcttggcctgatcgtgccttcgccacatagtttgcttcagttttgcatctgccattcacacggttggcatgaacttctcatgcagtgataacaactggagggtgattgcctagcaaactgactggtgactgcgcatttaattgacagtgntgtttggcggcgagatgtttttgttgggactacacctcnnnnnnactaccatgtncnnnnnnnnnnnnnnnnnnnnnnnnnnnnnnccnnnnncactaaatgcaannnnnnannnantgnc

SEQ ID NO: 28 - DNA, 680 bp, Zea mays
  misc_feature (34)..(34): n is a, c, g, or t
  misc_feature (146)..(146): n is a, c, g, or t
  misc_feature (258)..(258): n is a, c, g, or t
  misc_feature (334)..(334): n is a, c, g, or t
  misc_feature (383)..(383): n is a, c, g, or t
  misc_feature (462)..(462): n is a, c, g, or t
  misc_feature (517)..(517): n is a, c, g, or t
  misc_feature (548)..(548): n is a, c, g, or t
  misc_feature (593)..(593): n is a, c, g, or t
  misc_feature (612)..(619): n is a, c, g, or t
  misc_feature (627)..(627): n is a, c, g, or t
  unsure (1)..(680): unsure at all n locations
ttgaatttgctactctatacccccgctcaaaacnaatttgctactctatttctaatcttcacggccacaggtaaaaaccctatatttgagggcatgttaaccactgcacaacactttacgactctgaagaatgattaatttgcagnctcaaagaaaagcacttggggttgcaagtgacccttttcacacatcacgagcacatcaccccaactacctacaacctgcacaaataacatggaaccaaaattgggccacatnagtacgaacagtaaaaaggatgctcaaagtagtatggttattgggttaccttgactgtctggtcatcatacatganccatcgtccatccttgaaggcaaaacaatgataatgctggccatagtancaaacctgcaggagtaaaaaagcaataatgttatatatctaatgctccttgcatcgacagacagatgccaagcaccagntttagataaaagactatgtaaagacatgatgtttacttcaaaatgcaacacaccnttactgtaaatccattatatggagaaaatangtcatttggtaggtatagtaatgaagctaaatgggaaaaaaaatngacaacaaatggaaagatnnnnnnnnatgttacnccttttttaccacaatcagcaataacaatacagtcacattaacgttatatgca

SEQ ID NO: 29 - DNA, 374 bp, Zea mays
gaagctgctgagaaaattctccagacttacaatggcacacagatgcctggaactgaacacacattcagattgaattgggcctctttcagctctggtgagaggcgccctgatccaggatctgatcattcgattttcgtaggggacctggcacctgatgtcacagattacttactacaggaaacattccgagtgaactattcatctgttagaggtgctaaggttgtcacggatccaaataccgggagatctaaaggatatggatttgtaaagttcgcagatgaaaatgaaaagaaccgtgcaatgacagaaatgaatggtgtgtactgttcaacgagacctatgcggataagtgctgcaatacctaagaaatccac

SEQ ID NO: 30 - DNA, 842 bp, Zea mays
  misc_feature (2)..(21): n is a, c, g, or t
  misc_feature (204)..(204): n is a, c, g, or t
  misc_feature (252)..(252): n is a, c, g, or t
  misc_feature (298)..(305): n is a, c, g, or t
  misc_feature (310)..(310): n is a, c, g, or t
  misc_feature (318)..(318): n is a, c, g, or t
  misc_feature (345)..(345): n is a, c, g, or t
  misc_feature (354)..(360): n is a, c, g, or t
  misc_feature (400)..(401): n is a, c, g, or t
  misc_feature (614)..(614): n is a, c, g, or t
  misc_feature (762)..(763): n is a, c, g, or t
  misc_feature (766)..(766): n is a, c, g, or t
  misc_feature (831)..(837): n is a, c, g, or t
  unsure (1)..(842): unsure at all n locations
tnnnnnnnnnnnnnnnnnnnnaaatgcctggcaatctcaaggtaaaagtactgtctgtctgggtgcagtcataacacgcaccatttcatttatgtttttggatcctgcaggttgcgtattttgtgaattctgggaccgaagcgaatgagttggcaatgttgatggcccggctgtatagtgggaatctcagtatggttgcgctcngaaatgcatatcatggcggaagtgccggtacgattggattgactggtntgcagacgtggaaatacccaattcctcaggtatgtgtacagtgtannnnnnnnttgcnctttcatnaaattatttgactggttatgttttcanagtcacatnnnnnnngtttgctgcagtagattcttagttatcaataattatctcnncgttctacccagcaaaaatgtatccatttctttattacatctatcatagcctcataagaatttttgcagggtgaaatacatcatgtcatgaaccctgatccttatcgggggactttcgggtctgatgctgcagcttatgctaaggaagtcgaagaacacataacttatggaagttcaggaagggttgcaggcttcattgcagaaacattccangtataaactttgaacagaccatttataaaatgctagaactaattgaaataatatgtatcttttgtttataaacccaattcaaaataacttatccttgtcgcaatcttgttgatacaccatctctgctgtagggtgtgggaggtgctgnnaantagctcctggatacctaaagttagcttatgacattgtgcgcaaggctggtggcgtttgtattgcnnnnnnngtcca

SEQ ID NO: 31 - DNA, 428 bp, Zea mays
  misc_feature (293)..(293): n is a, c, g, or t
  misc_feature (299)..(299): n is a, c, g, or t
  misc_feature (306)..(306): n is a, c, g, or t
  unsure (1)..(428): unsure at all n locations
ctccttgaaaccgtcctcccgggcccattccgtcttctcactgccctgggcaccttcgggattcttagctgtctcgcgtgtgccagctttgttctggtgatgatgagatgcagaagctttcctcgacggtttttccttctccggtcgagattctttgctaggctcaggagtgtaagctttccagacagcactttgctgaacgataagcctgtgcagctcgaaaaacttggtgattgcagcttgtggatctacttcagaagattcccttatctcagaaaaaattctgtaaaagnacgtanagattanatttatttgtccagttcatgagctaaagtaaacaatgtagctccctagagaaaaaaaaactagacataaaagaaaaggtaaagcatgtgcgttgcaataaggaaacaagatcctgggatgca

SEQ ID NO: 32 - DNA, 979 bp, Zea mays
  misc_feature (320)..(320): n is a, c, g, or t
  misc_feature (397)..(404): n is a, c, g, or t
  misc_feature (411)..(411): n is a, c, g, or t
  misc_feature (424)..(424): n is a, c, g, or t
  misc_feature (614)..(617): n is a, c, g, or t
  unsure (1)..(979): unsure at all n locations
aacattcatacaacagttgaggtcacagatcgagcgtttagtcagtatgtacacggtctggtagttaacgtggaaatggagacaatatgcatggtgacttgacgagacaagggtgaaactccggaatcccaacgaccgtggctcttcatccgtcgaccatcggcgcggccttggggagcggctgccccttgatgaaggacgagaagagagcgaagccgcggcccggctggtcgatcggtaccatgtgcccggacccgcgcaccgtcgcgaacaccacgcccttgtactcgatcacgtacccggcgacctgccatgagaanatgtcattatcgccgtcgtcgcgggctctcagccatcacattttctagagttgcgttcattcaggtatatatatatnnnnnnnngggccgngcaaaggcatgcnactgcattacctcctggtccttggcgtcgatggaccaggggcgccagtcctccacgacgccgaggccgagcttctccatggaccgcttcgtcgcgatcacgggaaccatggcgtccaggtcgccactgcatgcaggtgacagcattacattctttgttatgttagctaaccagataccaacggcgcatgnnnnttgaggggattattatatttatttatatccaccgacctgaagacccacacgcggacgccggcggcggcgacggccttgacgtagggcagcatcgatttcgacggcgagtcaccgaacttgagcaggttgtagaacgtgcccctgtgccatgcatgcatcatatccaccacaggatttattagtttcttcttcgtgtcagctatggaagcacgtacgcgcgcgacggcctactagtagagccatctatatatacctgcatctagtccatttgtacttgagccctgtgttggcacggatggtcttcatcacctctggctggttcaggtacgcctccacgtagtattgagcgcaaggatcagcca

SEQ ID NO: 33 - DNA, 687 bp, Zea mays
  misc_feature (258)..(258): n is a, c, g, or t
  misc_feature (286)..(286): n is a, c, g, or t
  misc_feature (315)..(317): n is a, c, g, or t
  misc_feature (332)..(332): n is a, c, g, or t
  misc_feature (339)..(342): n is a, c, g, or t
  misc_feature (403)..(406): n is a, c, g, or t
  misc_feature (432)..(432): n is a, c, g, or t
  misc_feature (438)..(438): n is a, c, g, or t
  misc_feature (488)..(488): n is a, c, g, or t
  misc_feature (490)..(491): n is a, c, g, or t
  misc_feature (504)..(504): n is a, c, g, or t
  misc_feature (585)..(585): n is a, c, g, or t
  misc_feature (616)..(616): n is a, c, g, or t
  misc_feature (662)..(663): n is a, c, g, or t
  misc_feature (666)..(667): n is a, c, g, or t
  misc_feature (670)..(674): n is a, c, g, or t
  misc_feature (681)..(683): n is a, c, g, or t
  unsure (1)..(687): unsure at all n locations
tgtgtaatgagggctcgccggggtcgatcagatcgatcggtacgggggggcgtgtagtaatcgccgccttaaaggccgcacccaactcaggcgagcgagccacaccgccggccgcggcctgcctgcccgctgctgcgcaccaatggcgactactaactccccgtattaattgcccggccggagtagagtgccggcgccgcagcagcggtctacgtacgtagtactcgtcatgtattatcctgttcctgtgtgtgtgtntcgatcgactggaacgacgacgtgggtnagtgagtgagacacagcaattctggtgannnggtacgcagcgcgcncgtatannnngtactctcgatcgcgttcaactcgttcatcacaccggcgtcggcaggtcgtcattccatcnnnnaacagcgaccttgaccgccgtacttncgtgtnttcggctacgcttgccttcggagttcggattccgtttccccgatccatcnannactggcccggatncgcagcagagagatgctaacagtatcatcatcattggcaacatttatgcttgtacagttgtcgccaacaattttatggagncacaaaacaaacctatgctagttgctaggcntgtcgatcgtcgccctggccacgactccgactctcccggcccggcnntgnnaannnnnggtttcnnnggta

SEQ ID NO: 34 - DNA, 637 bp, Zea mays
  misc_feature (1)..(2): n is a, c, g, or t
  misc_feature (23)..(23): n is a, c, g, or t
  misc_feature (90)..(90): n is a, c, g, or t
  misc_feature (443)..(443): n is a, c, g, or t
  misc_feature (514)..(514): n is a, c, g, or t
  unsure (1)..(637): unsure at all n locations
nnagtaatatgatggtgcaatgnagaaacaaggcatgaacaacagaagaatttaaaacaagcaagtcaagaaccaactcatttcttcagncacataaaccttagcaacttcacaaatcagtataagctcagatcctgaccaccaatgtaccagcggaaacaaaggtcaaacacagaatctaaaatacacctgctagtgtcagcagtacttaatgatcgtgctcaagtactcaacaagcaactatctacaaggaaatgaccaaattataattttccatcgttcagtcacagttaacaagcaccagacactttgtaccctcaaataccaacacgcagaactacagatacaactaccacataaatcgtagacaaattggtagggcagattcaaaattagcaacgtaacaaacacctaacgagacacacttagcgaccagcctgcgnaccgcacggcgacatcccgacgctgaacacagccacaactaccagatcaggcgtcacgagcacggacaagngaacaggaaccaggcagcatggaaatggaatcacacgagcgcggtcggatcttaccagtccagaggcgctggcggtggagatggtcagcttctggtcgtaagtgtagtccttactgagtagat

SEQ ID NO: 35 - DNA, 1106 bp, Zea mays
  misc_feature (525)..(525): n is a, c, g, or t
  misc_feature (618)..(640): n is a, c, g, or t
  unsure (1)..(1106): unsure at all n locations
taagcttgcgaatccaacaaggatggtggcggctatatatatatgtgtgtgtgacttgtttgtctgaacaagaaacagagagcagcacgctgcatgctggaaactggaaggaatgcttgctcactcacactcacctgtcgtctgggcatcggcttgacgggggccggggagtactgcatttgcatgtagccgctcaaagcagccccgtttaagggagactgcaagaacaaggaaaatgcacaacaaaactgaaattagtcgcggcaccgtgtaataagcgagcgcaaacgaacggctgcgggggtagtgggtggcgcaccttgaatcccgtcgtggtggagaaggcgtacgagaagtcggcggcattgcccatctctgtcatctgggcatcatcagcgccgccatagccgccgttggcctcccccgagctcgtcgcctgggaaattaaggagcatatacatggcgtcgtcaccaatcacgaaggacagaggtgggattgcaagcacgacgcgtacgcgcaacgcntgggcaggggcacgccacgtgctaccacccaccctaccttggagtagacaaagaagggcggcgagctggccgtgtcctcgagcagagacgacnnnnnnnnnnnnnnnnnnnnnnncctcttgttcttctgccgcctcgccgcggcggccgtctcctcacgcctccccttcctctccgcattggcgtgcgcagcggcggcgccaccttcgacgtcgttgccggcggagctgtgctggcgcgggccggaggaggcgtcggagatcatagacaggtcgtcctcctccgagtagtactcgcagtagtacggctggcacggcttgccgctgaagcgcgcggtgccgcaggagtaggaagaggtgtggtcgtcgaggtaggtggtccagccggactggcagccgctgctgcactcggagctcgccgccatcgccatcgccagcttctcgtccattcctcccccaccgcacagctgcgccggctctcgaacaatgccacaccgcacgtacgcggcgtccctgtctgtctacgctcttctctactctcccacccgtccacccctaacgaatccctcacgagccaagcca

SEQ ID NO: 36 - DNA, 740 bp, Zea mays
  misc_feature (99)..(99): n is a, c, g, or t
  misc_feature (158)..(158): n is a, c, g, or t
  misc_feature (262)..(262): n is a, c, g, or t
  misc_feature (298)..(298): n is a, c, g, or t
  misc_feature (303)..(303): n is a, c, g, or t
  misc_feature (475)..(475): n is a, c, g, or t
  misc_feature (520)..(520): n is a, c, g, or t
  misc_feature (561)..(561): n is a, c, g, or t
  misc_feature (584)..(586): n is a, c, g, or t
  misc_feature (594)..(595): n is a, c, g, or t
  misc_feature (639)..(639): n is a, c, g, or t
  misc_feature (644)..(650): n is a, c, g, or t
  misc_feature (667)..(667): n is a, c, g, or t
  misc_feature (669)..(669): n is a, c, g, or t
  misc_feature (674)..(682): n is a, c, g, or t
  misc_feature (685)..(725): n is a, c, g, or t
  misc_feature (727)..(736): n is a, c, g, or t
  unsure (1)..(740): unsure at all n locations
gcagccaagcgtgttaacggggaatgctaccactgtactgagaagtacagcgcagatcataagtgtacatcaaaaggagtgtttttgctggaattagangatgggatggaagatggggacaccacagatgaattgggcatctcacttcatgctctcantggtattgactatggagaaacaatgaaactgcatatttccatcaatggtacagctatggtggctcttgtggactcgggagcgacacatacttttattagggaanacttagcaactaagattggcatgccagtgcagccangttcngggctatctgttaaggtggccaatggtgacaaaattaccagttccggcatttgtattgggcagcagatcatcatcgacaaggaacaattcaacatgacctgctacatgttacctcttgcagggtttgaggtcgtacttggagttcaatggcttcgctcattgggaccaatcntttggaacttcagggacttatctatggcgttctggcacaatggtngttcagtacgtctagcaggaattggaggttctgagcctcantgcacttcattacaaacaaccannnatctgctnnccactcttctggaatcctttgctgacatttttgaagcaccatangggcnnnnnnngatgcgccggcatgacnancatannnnnnnnntgnnnnnnnnnnnnnnnnnnnnnnnnnnnnnnnnnnnnnnnnncnnnnnnnnnnaaga

SEQ ID NO: 37 - DNA, 730 bp, Zea mays
  misc_feature (56)..(56): n is a, c, g, or t
  misc_feature (541)..(542): n is a, c, g, or t
  misc_feature (572)..(573): n is a, c, g, or t
  misc_feature (592)..(595): n is a, c, g, or t
  misc_feature (618)..(619): n is a, c, g, or t
  misc_feature (629)..(633): n is a, c, g, or t
  misc_feature (642)..(643): n is a, c, g, or t
  misc_feature (645)..(645): n is a, c, g, or t
  misc_feature (650)..(729): n is a, c, g, or t
  unsure (1)..(730): unsure at all n locations
tcatatctcatcccctatttcaaacttcactatgtaaacagtgcaatctacagtgnaaaaaatcctttattttacacgatttgccgcggatagccttaaggatttgatcagatattttccttacaacaccaacttaggcaaacatatctttatttttaccctcttatctagctggagagatgctacatgttgcacaggcattcatcgacaagaactaccatccaactgttatttgccgaggtaagattcctttattctcagtactgcactttactagggtaatacctgttttttatatcttaacttctgaaacttgtatttttcttatcttcagcatataccaaagcgcttgatgatgctattgctgtacttgacaaaattgcaatggctgttgatgtgaatgatcgtaagtttacagtgaacatatattttgtactggatcctggcactttgtcaatgccacaggaattagctcttccctcttgcatacaccatgtgttacacaattagactgatgtcaccaaatatactgttaatgcanntggggcaatgctaggccttgtgaagagctnnattggtacgaaattcactnnnnagtttggtgaccttattgctgtnngcatctttcnnnnntgtggaacnncnacaannnnnnnnnnnnnnnnnnnnnnnnnnnnnnnnnnnnnnnnnnnnnnnnnnnnnnnnnnnnnnnnnnnnnnnnnnnnnnnna

SEQ ID NO: 38 - DNA, 704 bp, Zea mays
  misc_feature (305)..(305): n is a, c, g, or t
  misc_feature (393)..(393): n is a, c, g, or t
  misc_feature (703)..(703): n is a, c, g, or t
  unsure (1)..(704): unsure at all n locations
cagtctcagcaaagcaacttcgcaacagtattcaagaatgtatggacaaacatatcagcacagcgcctaggtggtatgcaagctaccaagattacacccaacatccttcagtctatgatgtttccaaataattcttcagcttccaacttatggagctctcagaaggcagatgatcaagggcagagggcatcaactccatcagatattgcaacaacttcagctaactcacagaatcaagatccaaaacgagctgctgataatgatgcagggttagcatcttcccagaaggcaaacctagagtcganaggaactaccgtaacaggaggaaatgaacccttgcagaagcctttttcagatgggaattccatgaatgctgtttcatcctttgcacanttgcatcagcaaggcatccttggtgctaaacatggggaaaacccaggagccaattttcaggctatgaattcttcccacaatagtgttaataatagtggtggcattgttttacatggaagcccagcaccttcaaacattcagcagcaaaattactctcttctacatcaaatgcatgccttgaggcatacggatattgatccaggcagtttagctggaaagatgacaagacctgatgttggttctgatgcttcacagattgactggaaatctggccagaggtttgctcatgtagccaataaccaaaccaaanc

SEQ ID NO: 39 - DNA, 869 bp, Zea mays
  misc_feature (561)..(561): n is a, c, g, or t
  misc_feature (750)..(750): n is a, c, g, or t
  unsure (1)..(869): unsure at all n locations
ctatttacagcgtcggaaaccatgtggtagaactgttgggtcagttgggtcacagaaaagacattgcagaagaagtgtcacaccacctccaagttcacgaagagtgtctctcctaggatctagatcgcttgctgaaaatcctatcccatcagtgtcatcccatgactcgtgtttaccccataagaggcttgagacagctgaaaatagggacccatgtgctggggggcacataagtagctctgtgactccctgcacttctttgaaaaaccttgcatcaccgagttgcaaatcctcacaacctttgagtactaatttgaatactgatgctactccaagaaatttagacagaatggtaggcatacaaacacaagcactcgccaggagctccagttcgagtattttgcattctcaaggccagaacagtgaaaaagtgtctgctagtttgccaaaagaggcagtgacaaatcctgcgtctcctagtcccaagcaaattggtgctcaacatccaagtgacaatcctcttgttacgaaggcaggaccttctaagagtgtgtgcacacntgagagtgaaaagttgtgcagcagagacatcaatttaactgcaacaagtactacagttcctgtcttgcaagctcctgttgtggagcctgcattgctaagctcaacatctgtgttcactgaaaggccctttgaggtttatcctgacacaagaactgctgctcctggcatgcaggaacttagtgtgaagcntgtgttgctgaccccaatacctgtgcgtcatgaaccttctacggaggtatattataacactacaagatcaagcccaaatcctagatcggttttttgtaacaaaaataatgcaatttggc

SEQ ID NO: 40 - DNA, 946 bp, Zea mays
  misc_feature (2)..(2): n is a, c, g, or t
  misc_feature (5)..(5): n is a, c, g, or t
  misc_feature (10)..(12): n is a, c, g, or t
  misc_feature (25)..(25): n is a, c, g, or t
  misc_feature (59)..(59): n is a, c, g, or t
  misc_feature (76)..(76): n is a, c, g, or t
  misc_feature (149)..(149): n is a, c, g, or t
  misc_feature (152)..(152): n is a, c, g, or t
  misc_feature (174)..(174): n is a, c, g, or t
  misc_feature (192)..(192): n is a, c, g, or t
  misc_feature (211)..(211): n is a, c, g, or t
  misc_feature (222)..(222): n is a, c, g, or t
  misc_feature (415)..(415): n is a, c, g, or t
  misc_feature (434)..(434): n is a, c, g, or t
  misc_feature (782)..(782): n is a, c, g, or t
  misc_feature (913)..(917): n is a, c, g, or t
  misc_feature (929)..(931): n is a, c, g, or t
  misc_feature (937)..(943): n is a, c, g, or t
  unsure (1)..(946): unsure at all n locations
anctntgttnnntcttcactggaanccagttgcttactgagtgtcgtgataactgtggngctgcaatttttcttgnaggcgtgtctctttctactgtaggcaaaagtactcttgcgattaatcctgatctacacgaggctcagaatctnaantcatggtacgatttctctcgtnaatgatatgcgcttgtcntatgtttttaagtatgctnaggcttgtagnacatgatttgtcaaataggtatgactctgaaggcaaagatacttcgctggcaccaattggtgcagaaatgggtgccgcacgggccggtggcttcaagtccacgtattctgatagagtttttctgtctcacattactagtgatcctgccatgggccaggaaaaggtataatcgtcaatatccactgaacgatgntattatttatatcttgaantgaaaaattgtaaatttggagaacccccaatttgacccttttatttgttgcattgcagcctgttttctttagtttgtatgccaccataagccacatcaagcctgaccagaacatgtggtaccgtgcttgcaagacctgcaacaagaaggtgactgaaacttttggatctggatactggtgcgagggatgccaaaagaatgactcggaatgctcactgaggtaaaaaaaaatcgtcatcagaagcctgctgctactgttatctatttggtgccaaatctgacggtttccctgcgtccttcagatacatcatggtcgtcaaggtctccgatcctactggcgaggcatggntctctgtgttcaacgagcatgcagagaagatcattggctgcagcgccgacgagcttgatcggatcaggaaagaggtaaattccgcaatctgagtagagcagtgtcttgacatcgttgaatctctgctgttnnnnngtttgccgtatnnntgatannnnnnnacc

SEQ ID NO: 41 - DNA, 746 bp, Zea mays
  misc_feature (326)..(326): n is a, c, g, or t
  misc_feature (588)..(592): n is a, c, g, or t
  misc_feature (594)..(594): n is a, c, g, or t
  misc_feature (604)..(609): n is a, c, g, or t
  misc_feature (626)..(633): n is a, c, g, or t
  misc_feature (644)..(649): n is a, c, g, or t
  misc_feature (652)..(661): n is a, c, g, or t
  misc_feature (663)..(745): n is a, c, g, or t
  unsure (1)..(746): unsure at all n locations
cgatcgtgatgaaaacttcagttggccttgtctacctgcttgcctgtctgctatcacctttcatgccctccttttctgatgaagtatggtcctagatgtcactgtatcttgtatgatttaattggactaatgtttttcacttgaatctcatgatgcgatccttttgcaaaggtattacgtcaattaaatttatctccagaagaaaatttgtcattaagtgaagaaaagggagaaattgcaaaggcaaaatctccttgggattttgtaccagcagggcacagaatagggaagcctgcacctctgttcaaggaattggtgcgtttttncttttttataaatattttcaccacttgaccataattttacatatcttcacttgatatatgaatacagaaagatgaagacgtagctctccatagagaaaaatatgcagggagtcaagctgagagaagctcaaaagcagcagctgatgctgaagccaacaaagttgctaatcagctcaagggcacaaaattatccggtattgatctggacattcttatttattctccttatgctggttagggtgacaaacagaaaaatcttcgnnnnnangctattcttnnnnnnatcatgtattcatattnnnnnnnnctactatgacnnnnnngcnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 42 - DNA, 390 bp, Zea mays
  misc_feature (47)..(47): n is a, c, g, or t
  misc_feature (51)..(98): n is a, c, g, or t
  misc_feature (159)..(160): n is a, c, g, or t
  misc_feature (162)..(162): n is a, c, g, or t
  misc_feature (253)..(254): n is a, c, g, or t
  misc_feature (264)..(264): n is a, c, g, or t
  unsure (1)..(390): unsure at all n locations
tcggagaaggacgcgacgttgctgaagtcacgagccgcctcccgaangctnnnnnnnnnnnnnnnnnnnnnnnnnnnnnnnnnnnnnnnnnnnnnnnncatgcaggcaggtgtggagcgagcgagggaggtagcttggcttggctaggtacagaactanncntcttctcgtgtatctctgcggagtagttttcagtaccgccaccagtacgtaccaagaaggaagtagccggggtgtctcatagctggtgtgnngctagtaggnaacgagggtgcatgggaaagcctcctcagcacccttccttcgcgatcgatggatggtaaggactgaggagagcgaggagctgaaggaagcaatggagaggagagaccagggaatataagcaagggc

SEQ ID NO: 43 - DNA, 590 bp, Zea mays
agtgcagttgcagctagcgcccttgctctctctatcttttttcacgaggaccactggggcaccgcacagcattagtctctataatttaccggggcggaccaccgcggaatgtcgggcgtgggggcccacatgtccgcaccccctactacgtacctcccctcaccagcagccctgcctactattccatgggagcgtcgactaatagggtgtagccaagttctcgacttagcttgtcataatgcaaagctaagtagctagcctgcctgctgctgcgtactgtaaccgtataatatatctgcttaaccgctgtcatcaagcatcaaagatgcgcactgtaatgtaagcactagacaaagtcgtcccaaaagttcgagtatttatatagttgtggattctaacgcggggtcaaccgtgtttgaatcgctgcgtggacgtacgtgctccaactccaacatacatgcgggccggggcatgcaaggattcgggcatcattgacaattatgcctgggctctgctcttttttacgattgccaaaaatggcggcatctcgccctctctcggccccatatgcgtgtgggtgggcgtgggaa

SEQ ID NO: 44 - DNA, 722 bp, Zea mays
  misc_feature (233)..(233): n is a, c, g, or t
  misc_feature (303)..(303): n is a, c, g, or t
  misc_feature (317)..(317): n is a, c, g, or t
  misc_feature (328)..(328): n is a, c, g, or t
  misc_feature (602)..(602): n is a, c, g, or t
  misc_feature (606)..(609): n is a, c, g, or t
  misc_feature (626)..(627): n is a, c, g, or t
  misc_feature (629)..(630): n is a, c, g, or t
  misc_feature (635)..(635): n is a, c, g, or t
  misc_feature (665)..(666): n is a, c, g, or t
  misc_feature (668)..(670): n is a, c, g, or t
  misc_feature (675)..(678): n is a, c, g, or t
  misc_feature (680)..(681): n is a, c, g, or t
  misc_feature (691)..(693): n is a, c, g, or t
  misc_feature (695)..(695): n is a, c, g, or t
  misc_feature (702)..(703): n is a, c, g, or t
  misc_feature (707)..(710): n is a, c, g, or t
  unsure (1)..(722): unsure at all n locations
ctagcgaatctctccgtttgctattgtcttgaccttgcagattccagccgaggttgtgaagggcacatctttgtagcacgccacgagctcaccgttactgtgcagctcggcggccagcttctcccacgtcttgctcttgccactgagggaagcctcaggctcccccgagtacccagcaaaggtaacacgctcgcccacggcagcagattcgggtggctccaccaactcaaccnttacaagcgtagtcagaaatcaaaatgactggtactgtgctgtcttacattgatggtttccaattgaganctaaaaatggttcngtgtgaagttnactgtatttgaaggttaatatagatgactcaccttcgtgtggtcctcattcgatgcagccaaaaccattgcatgtgattttataccacgcattgccacaggtttcagattgcagagtacgcaaactttccggttctgctgatccatagtagatgttaagtgatacagggcatcaaaagacagtatctagaaagatcaaaatgatgcttagaaagggcaacctgcatttcttcgagaggtatgaatttgacgaggccactgaccactgttcttgntgtnnnntctccaacatcaatctnntnnacgtnaagggaatcagcatctggatgcttctctgnntnnntgatnnnncnnactctaatannnanttttgcnnccgnnnnatcagcatcagc

SEQ ID NO: 45 - DNA, 464 bp, Zea mays
  misc_feature (13)..(13): n is a, c, g, or t
  misc_feature (17)..(17): n is a, c, g, or t
  misc_feature (95)..(95): n is a, c, g, or t
  misc_feature (112)..(112): n is a, c, g, or t
  misc_feature (132)..(145): n is a, c, g, or t
  misc_feature (173)..(183): n is a, c, g, or t
  unsure (1)..(464): unsure at all n locations
atcgacgatctgntggncgcagacgaggtgttctgcaccgggaccgcggtggtggttgctcccgtgtcgacagtcacgtaccagggcgagaggtnacaactctctcctcgtncgttcttcgtgtgcccgggnnnnnnnnnnnnnntatcgacagagagtgacagagctttctnnnnnnnnnnnttcaggtatgagttcagaacggggccggacacggtgtcgcaggagctgtacacgacgctgacatccattcagatgggcatggccgccgaggacagcaagggatggacagtagcagtagagtagattaataaggttggggaatgccatcgccacgacattcgatcctacatcagtattgtcatccggtagaatgcatactcggttgatcagcatatgtagtgttgcagcaaattgaagaataaaccgtgtgtgttcgatggcgatcagtgacgaggccattg

SEQ ID NO: 46 - DNA, 673 bp, Zea mays
  misc_feature (114)..(114): n is a, c, g, or t
  misc_feature (125)..(125): n is a, c, g, or t
  misc_feature (141)..(141): n is a, c, g, or t
  misc_feature (145)..(145): n is a, c, g, or t
  misc_feature (229)..(229): n is a, c, g, or t
  misc_feature (294)..(294): n is a, c, g, or t
  misc_feature (332)..(332): n is a, c, g, or t
  misc_feature (347)..(352): n is a, c, g, or t
  misc_feature (416)..(416): n is a, c, g, or t
  misc_feature (523)..(523): n is a, c, g, or t
  misc_feature (529)..(530): n is a, c, g, or t
  misc_feature (532)..(532): n is a, c, g, or t
  unsure (1)..(673): unsure at all n locations
ggacatgaacccttgcccatcgtagaagaaccggagcttgtccttgtttggatggaagactcctctccatgccttggaaccgcctccgctcgtgaaatactggagtggactganacagaagaagnaatttcacaaggttcngtancttggaaacggactgaaagttacttgaattcatctctgtatcgtatggtgcttgtacctgtctctgctgctaatgtgctccagncagtgatcgtgtccattgatgtagaagtcgacgccattgtcctgaacggtgtgaatttttttccnacagaaacagtgttattattatggacctttctgaaagntgaaaccgattgagnnnnnnatagcttctgaaatgtaaccttgaggactggaagtagtaattccagaagctcctcggtgtcccngtgctcactcacactcctcatggtgtgatgcccaaccacaatcttccaccttgcagttgatttcttcatagccacatccagatcctgcatcgcagaacaacaacaanaaaaanngnttctataaaacgagcttcctttcacccgcactgacatggctgtgttcggagtgcgcaccttcagcaaattggcaatgtacttgcctcgaggcgccacccctctccagtcataacgatgcttgcccgggtgagtccaatact

SEQ ID NO: 47 - DNA, 669 bp, Zea mays
  misc_feature (12)..(12): n is a, c, g, or t
  misc_feature (57)..(57): n is a, c, g, or t
  misc_feature (61)..(61): n is a, c, g, or t
  misc_feature (63)..(63): n is a, c, g, or t
  misc_feature (137)..(137): n is a, c, g, or t
  misc_feature (155)..(157): n is a, c, g, or t
  misc_feature (253)..(253): n is a, c, g, or t
  misc_feature (323)..(327): n is a, c, g, or t
  misc_feature (440)..(440): n is a, c, g, or t
  unsure (1)..(669): unsure at all n locations
tggactcacccnggcaagcatcgttatgactggagaggggtggcgcctcgaggcaantacntngccaatttgctgaaggtgcgcactccgaacacagccatgtcagtgagggtgaaaggaagctcgttttatagaanctttttttgttgttgttnnnctgcgatgcaggatctggatgtggctatgaagaaatcaactgcaaggtggaagattgtggttgggcatcacaccatgaggagtgtgagtgagcacngggacaccgaggagcttctggaattactacttccagtcctcaaggttacatttcagaagctatctcaaannnnntcggtttcaactttcagaaaggtccataataataacactgtttctgtgggaaaaaaattcacaccgttcaggacaatggcgtcgacttctacatcaatggacacgatcactgnctggagcacattagcagcagagacaggtacaagcaccatacgatacagagatgaattcaagtaactttcagtccgtttccaagatactgaaccttgtgaaattgcttcttctgtctcagtccactccagtatttcacgagcggaggcggttccaaggcatggagaggagtcttccatccaaacaaggacaagctccgattcttctacgacgggcaagggttcatgtccc

SEQ ID NO: 48 - DNA, 903 bp, Zea mays
  misc_feature (1)..(1): n is a, c, g, or t
  misc_feature (3)..(27): n is a, c, g, or t
  misc_feature (31)..(31): n is a, c, g, or t
  misc_feature (36)..(41): n is a, c, g, or t
  misc_feature (47)..(47): n is a, c, g, or t
  misc_feature (51)..(54): n is a, c, g, or t
  misc_feature (57)..(57): n is a, c, g, or t
  misc_feature (64)..(71): n is a, c, g, or t
  misc_feature (87)..(88): n is a, c, g, or t
  misc_feature (97)..(103): n is a, c, g, or t
  misc_feature (107)..(108): n is a, c, g, or t
  misc_feature (167)..(167): n is a, c, g, or t
  unsure (1)..(903): unsure at all n locations
ngnnnnnnnnnnnnnnnnnnnnnnnnncagnaccgnnnnnnccggcnccannnnccncccgcgnnnnnnnnccgaggccatcccgtnntcctcacannnnnnncccnngatcctcgcccgcctctcggtggacccggactccgtcgaggcggcggagatggcgcagncgctgcgcgactgcgaggcgcccgcggccaagggcgagaagaaggcgtgcgccacgtcgctggagtccatggtggacttcgccaccgccagcctcgggaccaggcacgtgagggccgtgtcgaccgtcgtggcgaaggagggatcgccgaagcaggagtacacggtgaccggcgtggagcgcgctgccggcggcaccgacgacgacggccgggtcgtggcctgccacgcggagccgtacgcgtacgccgtgttcgcgtgccactgattctttgaatacttttttgggctcctgatcacctgtgctgacatcttcaagctttctcttcttatggttgtgctttgaatgtttggacgtctcacccagttggggagctttcttgtcactccttttatctttcttcttgtgagccctttccctttctttctgaagcttcagccaccagagcaatcgtcaattctgatttagaacagacgacgggatgcaatgcagtatttttgcaatatatgaattttgatatttacaaggacacaagaaatggttgtagcatttgcacagttcagacagtgatgcttcacaaagaatgttcaattatcattgacttataattacacagttagccaaagaattgcattcagtttacaatcatgttgaacacattactttcttgacaacagttaagacctgcaacactgcacactcttgaacaaaaactttcaatgaacacaaagatgtca

SEQ ID NO: 49 - DNA, 616 bp, Zea mays
tgcctgcagatatagcatctttgttctggttctagggttctttcggtttgtctccacgctttgcgccaacctttctcttctttcttgctatagtacgtagtagtacacaccgcaccacgaaagaaaaaaagacagtttggcactgccgctgtgttttgtcttatatgattcagactttcagcgatcagtacgaacagccttttcagggacagcgtttaggtccctaataatttcagcgctctaataatcatggctgctagcgacattttgccttgttggccttgttgaatgatttaggctgctgtgcacagtggcatctacgactacgacctagctagctaggtactagctttcatcgataaagtaaaaaagaaaagcattggttaataaaacgtattaaaaaaaagtagtgcaatatgcatgggagtaataatatatactactgtacctcacgggctgttgcggaccggaacgtgatcatgtgcgccagcgccgggatgatgtagacggtgaagctgacgaggagggagccgacggcggagttgatgggcccgaagaaggggaagatgatggcgaggaaccagatggggacgacgacggggaggcgcgcggcggc

SEQ ID NO: 50 - DNA, 770 bp, Zea mays
  misc_feature (34)..(38): n is a, c, g, or t
  misc_feature (252)..(252): n is a, c, g, or t
  misc_feature (315)..(316): n is a, c, g, or t
  misc_feature (388)..(390): n is a, c, g, or t
  misc_feature (692)..(693): n is a, c, g, or t
  unsure (1)..(770): unsure at all n locations
gagaaacccaagtatgtgctgtctccctgcctgnnnnngttgctcttggcttctcgttttttttgattccccgtttcctcggttcccccgtctcacacggaaagattggcactttggttcgttcggcggaacccagggaatgcagcgaggagatcaaagaggcggctgcggggctgatgttcgcgtccgcgcggtgcggcgagctgccggagcttctggacgcgcgcgccatccttgcagacaagttcggcngagacttcgccagggcggccaaggagggcgcccacggcgtcgtcgaccccacggtagctttannactcccttaagtttacaggttgtctcccccaactgcactgcatgatgggagttggaactgaaactggctgtnnntgcgctgttcgtttgtcgcagttggtgcggaagttgtccggcgagagggcgagcctggagcagacgaggaggttggcgaaggagatcgccgccgagaacgacatcttgctggagttccctgagagcccagtagggattcacaaagatggtcgcacgacctcgcaggtcaacagtcagagagcaggagaggaaactaagaatgcaccggccagaacatttgtcgaggagagtgcagtcaagacggatcgccgtgaggtttgtgccgtgatcacactacaggatcatcagaaatccagtatccnntgtggtatttgattaagaatcgatgtgtaacatgtgcagggggagcggaattctgttaacggcaaggtgaacccgag

SEQ ID NO: 51 - DNA, 255 bp, Zea mays
aattatatcaacgtactactgtatatgcatatgttctgaactatggtttgaattgtgatattgcagagacattaaatgcgcaaatattctggtgcatgccaatggatctgtgaaacttgcagattttggactcgctaaggaggtcgattgcatgctgcaaatttgacccttttttggttcaatttacctgctaccactttctctgatacaaaacttttttatgaattccctttcagatcaccaaattcaatgcag

SEQ ID NO: 52 - DNA, 965 bp, Zea mays
  misc_feature (4)..(6): n is a, c, g, or t
  misc_feature (53)..(53): n is a, c, g, or t
  misc_feature (64)..(64): n is a, c, g, or t
  misc_feature (73)..(73): n is a, c, g, or t
  misc_feature (75)..(75): n is a, c, g, or t
  misc_feature (99)..(99): n is a, c, g, or t
  misc_feature (156)..(156): n is a, c, g, or t
  misc_feature (167)..(167): n is a, c, g, or t
  misc_feature (177)..(177): n is a, c, g, or t
  misc_feature (510)..(510): n is a, c, g, or t
  misc_feature (818)..(818): n is a, c, g, or t
  misc_feature (862)..(862): n is a, c, g, or t
  misc_feature (902)..(902): n is a, c, g, or t
  misc_feature (954)..(954): n is a, c, g, or t
  unsure (1)..(965): unsure at all n locations
gcannntgacatcttcatggaaataaccactgtgccggatcaaaatcttcagngactcctccanatacctagngncagtcaaggaaatttggaaaggtnaaactgtgactagagcagcttagcatttcttaaactctccagcagcttactcatccncatatttaaantttactctangaacagtgcaaaacagtgttttcgatgaccatatggatgaactgctggagacgccctaaaggatacggagcataggcactcttcgtgtgtagtgcgaaaaaaccaatagcctgtgttgcagcagctttctcatctaatactccagtcctcacactgatatttctaactcttggttcatcattaacatcgtcatcagatgaaacaccgccaaatccattttcaatgctatcggcatcatcaatgtccacagcagaaccatcatccaagttgcaggaagaaaatacgagagggacaacatgaggaagatactgaaacgtgaaacaactcactttngtaaatgcaaaacatcaatcagaaattaaataaacttttaaagacccttgttacctgtgtaaaactatcacccaaaatttcagcaacgttactaaagaaaccatgagtgtactctctgagttcactgtaatccaatccaaaaccctgcgagtatgaagaacataaaggttgcactcaacgctgtaaaagtaactctgtaactgaggttaatgaaaccacaacttacagaaatagaagcctcaataaaaggaggcaatattgcttcaattcttgctctgccaactgccattgctactatcccaacaacntcagtagccctagcacgtgcacacagatcttcgtcattaattancaccataaaacctttcatcatctcaaggactttttcggcntatggggtaaaagcctgctccgcagcagcagccactgaaccaattgcagacngcaggcatgca

SEQ ID NO: 53 - DNA, 840 bp, Zea mays
  misc_feature (31)..(31): n is a, c, g, or t
  misc_feature (42)..(42): n is a, c, g, or t
  misc_feature (173)..(173): n is a, c, g, or t
  misc_feature (272)..(272): n is a, c, g, or t
  misc_feature (292)..(292): n is a, c, g, or t
  misc_feature (839)..(839): n is a, c, g, or t
  unsure (1)..(840): unsure at all n locations
ggcgtaaggtaccaatgctcgctccgctgcnacgtttccgtntgtccttccttgggataccctgcgtctcagtgttgctctggtgttggtgccgtagctattcggtggggaagtcatcggcgctgccgttcaggaagctctcgtcatcagacttcgacccgcgggagaaggtntggacgcggttcccgccagaggggtccaagctcacgccgccgcatcactccgtggatttccggtggaaggactactgccccgcagtattcaggtgccanactattgctctgctgatggntctggattttggtcatttggagaagaacggcaatgttttatgcgcatggatacattgcctgactgctgtgtgatgccaggcacctgaggaagctgttcggggtggatcctgcggactacatgctcgccatctgcgggagcgacacgcttcgcgagctggcgtcaccaggcaagagtgggagctgcttcttcgttacacaggacgatagattcatgattaaaaccgtgaagaaggcagaaatgaaggtcattcgtagtgacaatttgattttttctagactaaatatcttagtttatgagctagtcacatgcatgttttgagttttcttcgaccactttgatcatctttaattctgtgcctgaacgatttctgcaaaatgaaatctgtcgatacaaaatagcttttgtgatacccatttttagccgacacctgctccttttttttttctgtctctagaagttagattcgttgtccatctttattatcccaaattcagcttgtttgtaggtaacagtattcattgttattagttggcgacataaacatna

SEQ ID NO: 54 - DNA, 811 bp, Zea mays
  misc_feature (306)..(306): n is a, c, g, or t
  misc_feature (345)..(345): n is a, c, g, or t
  misc_feature (420)..(420): n is a, c, g, or t
  misc_feature (425)..(425): n is a, c, g, or t
  misc_feature (498)..(498): n is a, c, g, or t
  misc_feature (501)..(501): n is a, c, g, or t
  misc_feature (504)..(504): n is a, c, g, or t
  unsure (1)..(811): unsure at all n locations
aaagtaattagcaggatcgaatgaaaataggcagcatagcttacacattggaattgtgcactttagatagcaacatgtttagtcgggacctgccatcttggtatgcttcctcaacagatgcatgccggtccacattgacccaatggataacatatactttctaataaaacaagaaaagaaccatgtcatttgagatgaacacattttccccacaaattgtctccaagcgaacagcctcataaggtgcaaattacctaaatgcaacaaccggtgtagtttctgtctgttgtagatgtgaaaaaaaantaggatgaaacactgacaaactacatgcataatctttanaattagtatagttaacttcctatatcaaactactagctatcttattcagcctccaaaaaattggtgctccaaggnaaagngattaatacttaatcataactgcaactgtaggacaatactctgaaacacagagaacatcatgagttagttacnaanganaacagaaattcttgaatagtaccttctcaacattatcgaagactagaacatcatcatagagtcccaagtgcacatcaggaaggttcctatcgtcctgaggagcactggagaacggtagcttcttcttctcaacatacctaaccgtatcataggaaaagaacccaacccatccacctatcaagaacagaagaccaaaagtgactattcacataacatcatcggcaacatcaaatcttctctccttctcagcaatcgaggctgctcaccggagaaggattcagggagctcgtcgatctgctgtgggtgc

SEQ ID NO: 55 - DNA, 456 bp, Zea mays
  misc_feature (67)..(67): n is a, c, g, or t
  misc_feature (100)..(100): n is a, c, g, or t
  unsure (1)..(456): unsure at all n locations
taagctgtacatggacagcctcaaggagcccggcgactcggggaagccctactccgcgcggtacatnggcagcctcgtcggcgacttccaccgcactctnctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagaggtatcaaactacttgatcttgaatgtagaactgtgtccagctgatagattaaccagtttgcgtcgtgcagatccaccaaagagtgcctctgtacattgggagcgtggaggaagtggacaaggtggagaaattcctggcttgaatgccagagcctctctcatcagatggactcccgaagacatcaagtttagggagga

SEQ ID NO: 56 - DNA, 580 bp, Zea mays
  misc_feature (166)..(166): n is a, c, g, or t
  misc_feature (317)..(317): n is a, c, g, or t
  misc_feature (395)..(395): n is a, c, g, or t
  misc_feature (398)..(398): n is a, c, g, or t
  misc_feature (411)..(411): n is a, c, g, or t
  misc_feature (540)..(542): n is a, c, g, or t
  misc_feature (544)..(544): n is a, c, g, or t
  misc_feature (546)..(548): n is a, c, g, or t
  misc_feature (559)..(560): n is a, c, g, or t
  misc_feature (565)..(574): n is a, c, g, or t
  misc_feature (579)..(579): n is a, c, g, or t
  unsure (1)..(580): unsure at all n locations
taccggaatgctccaaggtgaggagctctcacaagcgtacgccagtggagatgtatttgcaatgccttcagaatccgagaccctcgggcaagtagtgctggagtccatggcttctggagtcccagtcgttgctgctcgtgctggagggatacctgatataataccnaaggacaaggagggtaagacaagctttctgtttacacccggagatctcgatgagtgtgtgaggaagatagagcagctcctcagttcaaaagatctcagggaaaccattggaatggctgccagagaagagatggagaagtgtgactggaggncagcctcgaagaaaatccgcaacgagcactacagcaccgcaatatcgtactggcggaagaagatgggcaagactaacnagncctccttgtttcnggattcttctgtcgctgccctctccaactagttgctgttaataactaaagaatttgtacattgtacccaaacagcttgcgagttttgtgtggctagctgcattcaaatgtccacagtctgactgactannncntnnnttcgattcatnnacatnnnnnnnnnncttang

SEQ ID NO: 57 - DNA, 533 bp, Zea mays
  misc_feature (479)..(479): n is a, c, g, or t
  unsure (1)..(533): unsure at all n locations
ctcaggatgttccaaggtctgtgatttgtaatgttcatggagttaaccccaaatttattgagattggcaaattgaaacatcagcagctatgccaaagagagcaagcattcttcaagggtgcatattatatcggaaagatggtatggagtaaaggttacacagagcttcttcagcttcttcataagcaccaaatggaattgtctggccttaaaatggagttgtatggcagtggggaagatgctgatgaagtaaaggcatcagctgagcgactgagcttagatattagagtctatccaggccgtgatcatggagattcaatattccacgagtgagtatttaatagatgaacaataactttttatacattcttactagctgctagattgttttatgttcaggtataatttatgataagttctttgtaccatcactttataatctttgagtctcgactgaactgtgttattgattccattgtntgtcccagctacaaggtcttcataaacccaagtacaactgatgtggtatgcaca

SEQ ID NO: 58 - DNA, 812 bp, Zea mays
  misc_feature (710)..(712): n is a, c, g, or t
  misc_feature (717)..(720): n is a, c, g, or t
  misc_feature (750)..(757): n is a, c, g, or t
  misc_feature (775)..(791): n is a, c, g, or t
  unsure (1)..(812): unsure at all n locations
gtgctcagtggtcagtgcgaggtgtccacgagtcaattaaagttggtttcttattcgtacaaagcatgcaactcttgaacagtttaataactacatatttgtcggatgatcctttcttctctcttagctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttaggtgtgccaatacattccattcgactcatttgatggtttatagtgtttcctgaaaacttagtgccatggaaattttttgtttcagattatgacactctgagagcattggatgctgacaatagcccacatgctccatctatgagtgaagaagaaataaattctcttcctgtcttcaaatataaagttcaggcacaacagaggcatccccctgcccgaaaaaggtaaagccgaattgtcctttgggttgatttgttcatatcaccatatcgagttggttccagtatttcccatcaacacatgaccaacatttaattctgaaatggagacatgaagtaattttttctaatgtttgttttccaatagtgatggnnnatctnnnntatcagtttcttcaactgggtccggcaatnnnnnnnntgataaatactgacttgnnnnnnnnnnnnnnnnnttgaaaagtatcttattatca

SEQ ID NO: 59 - DNA, 740 bp, Zea mays
  misc_feature (170)..(170): n is a, c, g, or t
  misc_feature (263)..(263): n is a, c, g, or t
  misc_feature (280)..(280): n is a, c, g, or t
  misc_feature (359)..(359): n is a, c, g, or t
  misc_feature (431)..(431): n is a, c, g, or t
  misc_feature (509)..(509): n is a, c, g, or t
  misc_feature (595)..(598): n is a, c, g, or t
  misc_feature (609)..(613): n is a, c, g, or t
  misc_feature (617)..(618): n is a, c, g, or t
  misc_feature (621)..(623): n is a, c, g, or t
  misc_feature (625)..(625): n is a, c, g, or t
  misc_feature (628)..(628): n is a, c, g, or t
  misc_feature (631)..(632): n is a, c, g, or t
  misc_feature (635)..(636): n is a, c, g, or t
  misc_feature (645)..(646): n is a, c, g, or t
  misc_feature (648)..(648): n is a, c, g, or t
  misc_feature (650)..(659): n is a, c, g, or t
  misc_feature (663)..(674): n is a, c, g, or t
  misc_feature (676)..(684): n is a, c, g, or t
  misc_feature (686)..(686): n is a, c, g, or t
  misc_feature (689)..(701): n is a, c, g, or t
  misc_feature (707)..(734): n is a, c, g, or t
  misc_feature (736)..(738): n is a, c, g, or t
  unsure (1)..(740): unsure at all n locations
agtcctcttccattgcggtcggtgaggaatccttcctgcgcttgttacaggtggctgtgatctccatgccatccccagaactgtgattggatggttgcgtcgagaggttaaggccagaaccgttcagcaacttcttgtggtgtccatgtgaactgctctttgcaggagcngcggttgctggcctctcgagctcaaagtctgtgctcggcagattcctccaggactcaaaatcactcgcctcagttgggaccgagaaattggcntccctcccagtgagctncatccacctctttaaatcagcctcaggtacacccgccaaatttggcgccctcacgatttcgatcccatgaagacactgngggttagagaggccacggtagtgcttgcgctgcatccggtgtgagcgcacaaaccctttgtctgcgctgaangggaactgtggctccccaaggcgtgagtgcccattcatgaagctcctcagctgcatcttccccagggcattctccggncgctccttaaacacccacatgtagatgttctccatgtcgtgctgcaccaggaaagcgtccagtgtggcgctattgccgttcccgcnnnnggtggtggctnnnnncgcnntgnnngnctngtnngcnnacatgactnncntnnnnnnnnnngtgnnnnnnnnnnnngnnnnnnnnntnctnnnnnnnnnnnnnacacannnnnnnnnnnnnnnnnnnnnnnnnnnntnnntg

SEQ ID NO: 60 - DNA, 714 bp, Zea mays
  misc_feature (4)..(5): n is a, c, g, or t
  misc_feature (18)..(18): n is a, c, g, or t
  misc_feature (22)..(22): n is a, c, g, or t
  misc_feature (84)..(84): n is a, c, g, or t
  misc_feature (263)..(263): n is a, c, g, or t
  misc_feature (273)..(273): n is a, c, g, or t
  misc_feature (284)..(284): n is a, c, g, or t
  misc_feature (320)..(320): n is a, c, g, or t
  misc_feature (498)..(498): n is a, c, g, or t
  misc_feature (605)..(607): n is a, c, g, or t
  misc_feature (611)..(614): n is a, c, g, or t
  misc_feature (651)..(660): n is a, c, g, or t
  misc_feature (666)..(666): n is a, c, g, or t
  misc_feature (670)..(671): n is a, c, g, or t
  misc_feature (675)..(680): n is a, c, g, or t
  misc_feature (684)..(686): n is a, c, g, or t
  misc_feature (688)..(688): n is a, c, g, or t
  misc_feature (691)..(695): n is a, c, g, or t
  misc_feature (697)..(705): n is a, c, g, or t
  misc_feature (707)..(710): n is a, c, g, or t
  misc_feature (712)..(712): n is a, c, g, or t
  unsure (1)..(714): unsure at all n locations
tacnncacttacgatgtngttntccaggattcattgtgttcattgctgttgtttgggtcatacaagaatttacatctttccatnttctgaaatatgtgatcttattcataggtgagacagaagatgtcgtacaatcatgttctctttattttaatttctggaatgcaaattgtatgcttgaaatttaatctttatgtttatttatgtgcaacaggtgtgatgaacagcttattttcagtttacggtaaagaaacaaaaaaaancttttccttnttattccatgntagaataatccatgtgttactctcaatgaaatattntcaaattatatagatatttatgatgacttgatatcccgaagagttaacacaagtgatgctgaaaagtttgctgaaatctgcccttgcccctgcaatggttttgcatggggtgttatatggtctgctccaagtttcgatagttatatttttctgtataccttgatgatgtgttaagatnttcctgatgtaacgacaccaatgctaacgttttctgttctttgtttcaggggattcatctcgtttatctttctctgcgcttcaatataccttggactggtcatattnnnttgnnnngattcctatgttttcatatcactgcatttttattctnnnnnnnnnnacatgntagnncacnnnnnnactnnnanacnnnnnannnnnnnnnannnncnac

SEQ ID NO: 61 - DNA, 722 bp, Zea mays
  misc_feature (251)..(251): n is a, c, g, or t
  misc_feature (288)..(294): n is a, c, g, or t
  misc_feature (446)..(446): n is a, c, g, or t
  misc_feature (456)..(456): n is a, c, g, or t
  misc_feature (576)..(576): n is a, c, g, or t
  misc_feature (605)..(605): n is a, c, g, or t
  misc_feature (608)..(608): n is a, c, g, or t
  misc_feature (642)..(642): n is a, c, g, or t
  unsure (1)..(722): unsure at all n locations
tattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggtaacgtctctccgcttcgccccgtcccaccaaactcgtcgcactaatacaaaacaggtgtgtgcgtgaatttaaagctgcgggcacttggataccttaatgctatgnttgtgagcaatccatttggggaactagggataaccannnnnnngtaagctttatcgatgaagcacaacatttaaacctgttacagactcctagtttgcatcccatcctgcagtgttgatgtcagaggttggcaatggtgcgaatactcttttttgggtggataaatggattaatgggaaaaaggtagctgatatngcaccaagantgttctgcaccatatcaaaaagaattgccaataaaagaacagtgcaagaggcaatggacaataggagatggattagtgatattaggggcgctctctcagcaggggccttgattgattttntgcatctctgggaagctttaacggatttncanctgcatcctgatattgaagacagacacatttttnccatagcgccagatggtaactactcagcaaaagttgcttatgaagggctcttccagggatcgtgctcctttcttcaccac

SEQ ID NO: 62 - DNA, 827 bp, Zea mays
  misc_feature (396)..(396): n is a, c, g, or t
  misc_feature (547)..(547): n is a, c, g, or t
  misc_feature (606)..(606): n is a, c, g, or t
  unsure (1)..(827): unsure at all n locations
tgcgggttcgacgagggcatggtgatcggcgtgggcgggttcgggaaggtgtacaagggcacgctgagggacgagacgcaggtggccgtgaagcgcggcaaccggcggtcgcagcaggggctgaacgagttccgcacggagatcgagctgctctcccggctgcggcaccgccacctggtgtcgctcatcggctactgcgacgagcgcggcgagatgatcctggtgtacgagtacatggccaggggcacgctccggagccacctctacgactccgagctgcctcccctctcgtggaagcagaggctcgacgtgtgcatcggcgccgccaggggcctgcactacctccacaccggctcggccaaggcgatcatccaccgggacgtcaagtccgccaanatcctcctcgacgacagcttcatggccaaggtcgccgactttgggctgtccaagaccgggccggagctggacaagacgcacgtcagcaccgccgtcaagggcagcttcgggtacctcgacccggagtacttccggcggcagatgctgacgnacaagtccgacgtctactccttcggcgtcgtcctgctggaggtgctctgcgcccgtccngtcatcgacccgacgctgccccgggagatggtcaacctggcagagtgggccacgcagcggctcaaaaacggcgagctcgacagcatcgtcgaccagcggatcgctgggtcgatacggccggagtcgctcaagaagttcgtcgacaccgcggagaagtgcctcgcggagtacggcgtggagcggcccgcaataggggacgtgctctggtgcctcgagttcgc

SEQ ID NO: 63 - DNA, 708 bp, Zea mays
  misc_feature (5)..(6): n is a, c, g, or t
  misc_feature (418)..(418): n is a, c, g, or t
  misc_feature (546)..(553): n is a, c, g, or t
  misc_feature (563)..(567): n is a, c, g, or t
  misc_feature (577)..(579): n is a, c, g, or t
  misc_feature (584)..(585): n is a, c, g, or t
  misc_feature (588)..(593): n is a, c, g, or t
  misc_feature (595)..(596): n is a, c, g, or t
  misc_feature (611)..(626): n is a, c, g, or t
  misc_feature (631)..(636): n is a, c, g, or t
  misc_feature (644)..(659): n is a, c, g, or t
  misc_feature (663)..(674): n is a, c, g, or t
  misc_feature (687)..(697): n is a, c, g, or t
  misc_feature (701)..(706): n is a, c, g, or t
  unsure (1)..(708): unsure at all n locations
tgcannatggacaataccagcttccttctggaatggcctacaaaagcagaatgcaactgaaatatctttcctaaagcaagtgtaaatagaaagaacttgtgcagaaataactgaagaaacacaggaatgatataatgcacatgctcttcatcatactcaaaaaagagaaggaacatttatcataagttctcactaccaatatgatatggattgagacttgagcaagaatattcatcaaaaactaacaaccatataactaaagcaaatggaagcaaaaactgtcatgttaccaggctacttattggaagcttgcaagttgcaacaatagaggtactagcagattgaaactagagactaagtagatagattcacacataggataatggagtacctctacctccaagccgacacaatcatnatgataagatgatgggcaattgtcacaaagtaataaatccccaccatcatggcacacagagcatatcgaatcactttccagatcagaactactccccttcaagcgcacatgcagtggatctctgggcnnnnnnnnacccatgaannnnnctaaacactnnnatagnnacnnnnnntnntttaaaaacatatgnnnnnnnnnnnnnnnngtacnnnnnncagcatgnnnnnnnnnnnnnnnnacannnnnnnnnnnnttacaacacatgnnnnnnnnnnnatcnnnnnnga

SEQ ID NO: 64 - DNA, 693 bp, Zea mays
  misc_feature (479)..(479): n is a, c, g, or t
  misc_feature (550)..(550): n is a, c, g, or t
  misc_feature (575)..(575): n is a, c, g, or t
  misc_feature (578)..(579): n is a, c, g, or t
  misc_feature (582)..(583): n is a, c, g, or t
  misc_feature (618)..(619): n is a, c, g, or t
  misc_feature (621)..(628): n is a, c, g, or t
  misc_feature (644)..(651): n is a, c, g, or t
  misc_feature (656)..(665): n is a, c, g, or t
  misc_feature (669)..(671): n is a, c, g, or t
  misc_feature (675)..(675): n is a, c, g, or t
  misc_feature (677)..(682): n is a, c, g, or t
  misc_feature (686)..(687): n is a, c, g, or t
  unsure (1)..(693): unsure at all n locations
acttttgtcacatgaagagagagatggtttacctgtgtcaatcaggcagatatggtttgacttaagatccaaaccttcttttaagactgatgccaaaatgtggatgtgtggaacagaagatttttgggagagatcacttgcagatgtcattgctgaattgtggtctctatgtgacaagcctaccctagatggatatcaagtggaagcagttcagaaggatacagttgagaccactgtcttggataagctggatccattccaagcattatcagaatacatctcatgctatcggaataataggaaaaatgctcttatcaaaaaagagtgggcaaagcaacaccttaaatcttcaggatggacctttctggatgacagacctaagaacaagttttacatctcacctgatggtaagcggtttccatcttttctaggagcatgccaggcgtgtttggctgcaaaagaagcaaatggttaccaanatgatcatacagaaaatttgcatctagacagtatgagtctggtgcacaagaatgcatgctacaaccagacncacatggatcttgccttggtaaagnacnngtnnaatgataaatggatcacgagcccatcaagatcttnngnnnnnnnncaactggatgctgaannnnnnnnacagnnnnnnnnnnttcnnnctantnnnnnngatnncactac

SEQ ID NO: 65 - DNA, 630 bp, Zea mays
  misc_feature (38)..(38): n is a, c, g, or t
  misc_feature (133)..(133): n is a, c, g, or t
  misc_feature (239)..(239): n is a, c, g, or t
  misc_feature (256)..(256): n is a, c, g, or t
  misc_feature (329)..(330): n is a, c, g, or t
  misc_feature (375)..(375): n is a, c, g, or t
  misc_feature (399)..(400): n is a, c, g, or t
  misc_feature (536)..(543): n is a, c, g, or t
  misc_feature (551)..(561): n is a, c, g, or t
  misc_feature (573)..(581): n is a, c, g, or t
  misc_feature (592)..(599): n is a, c, g, or t
  misc_feature (608)..(627): n is a, c, g, or t
  misc_feature (629)..(629): n is a, c, g, or t
  unsure (1)..(630): unsure at all n locations
aaaaatctcaccatgtgctatcctacatctggctaagnttttcctgtaacctaaaccgatttaactttgtagaagaacatcacatcaagtgacctctatctccatgatgcgatcgtctctttgaagaaaaaancatataggctggaattggctaccttggccagccagttatccaagtccctctgcaaaagagaacaaagacaacaaaactgtcacggagttgtatcttctggaaaatngaacagtcacacgtgantaacttctcatgcattcaaagcagattatcactccatttctgaacaataacagtcgcttatggaaatttgaanngtctctgtttgctagaggtgagacaggagatttcagcaggggtangcttgcataatgagtagtttcatnngaaagatcagcattcctacactactacataccaaacgatatgagcaaccaattcgatgcccattctagaaattaagaatgtctagccaaatcgagtgatcatgtgttagctgatattctcatagtgaagtggaaannnnnnnncgcgctgnnnnnnnnnnncaacatgaaccnnnnnnnnncgaacgtgaannnnnnnntaatcattnnnnnnnnnnnnnnnnnnnngng

SEQ ID NO: 66 - DNA, 763 bp, Zea mays
  misc_feature (1)..(1): n is a, c, g, or t
  misc_feature (6)..(8): n is a, c, g, or t
  misc_feature (12)..(14): n is a, c, g, or t
  misc_feature (35)..(35): n is a, c, g, or t
  misc_feature (37)..(37): n is a, c, g, or t
  misc_feature (106)..(106): n is a, c, g, or t
  misc_feature (208)..(208): n is a, c, g, or t
  misc_feature (587)..(587): n is a, c, g, or t
  misc_feature (626)..(626): n is a, c, g, or t
  misc_feature (687)..(694): n is a, c, g, or t
  misc_feature (717)..(717): n is a, c, g, or t
  misc_feature (729)..(732): n is a, c, g, or t
  misc_feature (747)..(749): n is a, c, g, or t
  unsure (1)..(763): unsure at all n locations
nttctnnnatcnnnacgtttaagccccgatgttcnantgctagtgcctttgttgatcctcttgagaatacctgctataacctggatgccagaaagaaaagaaaaanaaatagtgcaagagcattactactttactagtgagttcggttatactacaataacttggaaatttcaaatttacctcattgctataactcgacaaacattantaaacagtaaataaatcacaaacaggaacttacctttccaggtccgagttcataacttatctcaagccccttgcccataagattcttaacagtggtttcccattgcaccggagaggttacctgttgtgcaggtacgtcagaggtatgcaaccgttaaaaaccacttcagcccacaaagttagcctgcagtaagaattcaaaactcacctgctgagctaaaatctgcttgatggtgttaggatctgagtggggctgcgcatcaacattggagatgaccggaattctaggtgttctaatctcagtggcagccaacgcagattccaatcttgaaacagctggttgcatgaagctagtatggaaagcgccagcaacagctagncgaacctggaaatacaatggttaacaatgtaaattcctntggtagcatactaagattgaaacaaaaaggaaaatgggacataagaactgaaaactaaaannnnnnnnaccatataaaattatagataatnattccacaaatnnnntcaagcaaaacattnnngaacaccgaccgtc

SEQ ID NO: 67 - DNA, 992 bp, Zea mays
  misc_feature (1)..(3): n is a, c, g, or t
  misc_feature (35)..(35): n is a, c, g, or t
  misc_feature (37)..(37): n is a, c, g, or t
  misc_feature (112)..(113): n is a, c, g, or t
  misc_feature (241)..(241): n is a, c, g, or t
  misc_feature (363)..(363): n is a, c, g, or t
  misc_feature (382)..(382): n is a, c, g, or t
  misc_feature (402)..(402): n is a, c, g, or t
  misc_feature (602)..(612): n is a, c, g, or t
  misc_feature (637)..(637): n is a, c, g, or t
  misc_feature (733)..(733): n is a, c, g, or t
  misc_feature (894)..(894): n is a, c, g, or t
  misc_feature (961)..(961): n is a, c, g, or t
  misc_feature (964)..(964): n is a, c, g, or t
  misc_feature (987)..(991): n is a, c, g, or t
  unsure (1)..(992): unsure at all n locations
nnngctgctaatgacgaagtagatgaaaacgatananttcaaatagcaaactttctgtgccctgtaagtgttttgtctgatattgtcgttaacctaatgctggctcttgatnnatatgaatcgaagtacataaaaatacattgcaggggaattatgcagtttctggtggtgtaaaaggtattgaagtagtcgaagccaaagcaaagtccttcaaggccagaatgacggtcggtgttcccanaatgttttgcttgagccatatttgtggaattattatctataattttatatggttaaccatattttagttttcagttcttatgtcccattttcctttttgtttcaatcttagtatgctaccanaggaatttacattgttaancattgtatttccaggttcgnctagctgttgctggcgctttccatactagcttcatgcaaccagctgtttcaagattggaatctgcgttggctgccactgagattagaacacctagaattccggtcatctccaatgttgatgcgcagccccactcagatcctaacaccatcaagcagattttagctcagcaggtgagttttgaattcttactgcaggctannnnnnnnnnnactttgtgggctgaagtggtttttnacggttgcatacctctgacctacctgcacaacaggtaacctctccggtgcaatgggaaaccactgttaagaatcttatgggcaaggggcttgaganaagttatgaactcggacctggaaaggtaagttcctgtttgtgatttatttactgtttagtaatgtttgtcgagttatagcaatgaggtaaatttgaaatttccaagttattgtagtataaccgaactcactagtaaagtagtaatgctcttgcactatttntttttcttttctttctggcatccaggttatagcaggtattctcaagaggatcaacaaaggcactagnatngagaacatcggggcttaaacgtnnnnna

SEQ ID NO: 68 - DNA, 634 bp, Zea mays
  misc_feature (107)..(111): n is a, c, g, or t
  misc_feature (196)..(196): n is a, c, g, or t
  misc_feature (198)..(199): n is a, c, g, or t
  misc_feature (201)..(201): n is a, c, g, or t
  misc_feature (204)..(205): n is a, c, g, or t
  misc_feature (208)..(209): n is a, c, g, or t
  misc_feature (213)..(214): n is a, c, g, or t
  misc_feature (217)..(217): n is a, c, g, or t
  misc_feature (219)..(219): n is a, c, g, or t
  misc_feature (258)..(258): n is a, c, g, or t
  misc_feature (503)..(505): n is a, c, g, or t
  misc_feature (507)..(508): n is a, c, g, or t
  misc_feature (546)..(550): n is a, c, g, or t
  misc_feature (554)..(555): n is a, c, g, or t
  misc_feature (578)..(579): n is a, c, g, or t
  misc_feature (601)..(633): n is a, c, g, or t
  unsure (1)..(634): unsure at all n locations
ttattatttggtcgctgatgtgatgaacaactcgtctgcctcaggcttccacgtccgagtggatccgagctggtcacgcatgaggcaaacactccctctcgcgtacnnnnngcagatcatccacctgtccagccccggcgccagccagcacgaccagaccacgctctccctctcgccggtgccgaacactaggcangnngncanncanngtcnnccngncccgcccaaccaaactctccagggatacggctctctctncctctcggtctgtctggtctgcatgtccacatctggagctccacggccacggagatgcttgcggttgcggaagggagctgggctggaggccgcctcgcgttccacacttccgcgaacgtgctgccgcgacgggcgcacgaaagagggacggagaagtgtgccgctcggtccagcccacgcccgctcccccccgcgctataagtagcggcccggtccgccgagtcgagccgtccacagcagagtannntnncacacgcactcgcctcttgtgtctttctttgggagctnnnnncganncacacacagcagcagcagcagcnncaacatacatgcacgctagccnnnnnnnnnnnnnnnnnnnnnnnnnnnnnnnnnt

SEQ ID NO: 69 - DNA, 872 bp, Zea mays
  misc_feature (19)..(19): n is a, c, g, or t
  misc_feature (152)..(152): n is a, c, g, or t
  misc_feature (249)..(250): n is a, c, g, or t
  misc_feature (273)..(273): n is a, c, g, or t
  misc_feature (278)..(278): n is a, c, g, or t
  misc_feature (290)..(290): n is a, c, g, or t
  misc_feature (382)..(382): n is a, c, g, or t
  misc_feature (477)..(477): n is a, c, g, or t
  misc_feature (486)..(486): n is a, c, g, or t
  misc_feature (576)..(576): n is a, c, g, or t
  misc_feature (851)..(852): n is a, c, g, or t
  misc_feature (866)..(871): n is a, c, g, or t
  unsure (1)..(872): unsure at all n locations
gcggttttgactgaattgnctttggtttacacaaattagatactggttaccattatgggttgatttgggttgggccagaggtttagacaatgatgaaccgccatccgctgcaagaacttagttatttgtgtagcaacagcagtcttcttagnggcagcggcagcagcagcttggcatagtgttcctgtgtagcagtccaaaggttgaagatgaccaaggatgggttagccagtttgatttattctaaanngagagagccaaccctcttccaangatgnggtttttgactntggaacgagtaaacccattgcaaaccgttaccctgatttgatctgtggattggtttgtggggtgaaccggtttgacccacccagtgaacagngttaatttttgtactcagtaaacccattgcaaaccgttaccctgatttgatctgtggattggtttgtgggtgaactggttttgacccaaccagtnaacagggcnaatttctgtactcaattgtggttttgttgatttctataagctataactgaatatgtatttcccctatcacttgaattgaaataaaagaanagcttaaacaccaacttacccagggtggcaatcgctgaccttccacttccaatgtcccgcggcaacatcaagtgcaagcacatctccactgcctgtaccaagcacaatcaatgagctcccagccttcctcttcttctgctaaggaaaaaaaatgtaagcaggtgacaagggtgcatcccaacataacaagctggcggtggtcgggcggattcgctcaccttactggaaagttgtacccacttcatgcaggtgtaatcgagggcgaggtggccgcnnttcgactcagcgannnnnnc

SEQ ID NO: 70 - DNA, 873 bp, Zea mays
  misc_feature (106)..(106): n is a, c, g, or t
  misc_feature (167)..(167): n is a, c, g, or t
  misc_feature (170)..(171): n is a, c, g, or t
  misc_feature (246)..(253): n is a, c, g, or t
  misc_feature (276)..(276): n is a, c, g, or t
  misc_feature (278)..(278): n is a, c, g, or t
  misc_feature (281)..(281): n is a, c, g, or t
  misc_feature (290)..(290): n is a, c, g, or t
  misc_feature (305)..(311): n is a, c, g, or t
  misc_feature (318)..(318): n is a, c, g, or t
  misc_feature (327)..(327): n is a, c, g, or t
  misc_feature (343)..(343): n is a, c, g, or t
  misc_feature (385)..(385): n is a, c, g, or t
  misc_feature (387)..(441): n is a, c, g, or t
  misc_feature (444)..(444): n is a, c, g, or t
  misc_feature (446)..(446): n is a, c, g, or t
  misc_feature (449)..(450): n is a, c, g, or t
  misc_feature (465)..(465): n is a, c, g, or t
  misc_feature (478)..(478): n is a, c, g, or t
  unsure (1)..(873): unsure at all n locations
cgtgttttccagttgacgttcacggaagtcttgtgtcttttggatagactgatagtgataggcacgcataacagtaaacatattctgtgctccgtgctcatatgancactttaaatctagtgtatacgtgagtaatctagctctgatatcatctcagccttgatagncanncagagagtaaatgaacacggaataagatcccgcataactacctagccacagacactgctgctcctggcgagtggnnnnnnnncgaacaaggtttcccatcttttngngcntgccatacntggattttttttaannnnnnntgtatcnaaattgaanttggaagtgtatactntcccagtcgcacaaagagtgttctttcgacttttgagaagtngnnnnnnnnnnnnnnnnnnnnnnnnnnnnnnnnnnnnnnnnnnnnnnnnnnnnnnnctncntcnntcctaaaataggttngtttagcacttantttttatgtttatattcaaatagatgatgacgaatttacaaatatatatcaaacatatgcattaagtatacattaagtctagtcaacagagagagtaagtattattataatatttgctaaatattttttcataataaacattttttagatacaaaggttgataatacgttttctataaatctagtcaaactaaacaaagtttgacctgaacataaccctaagtgacacttttttggtgtaacgctagctagagcaccaacagcttagcaatgcttgcagtgacatgtttttatttcatttcttttcttgtatccctgttcatcttcaccatttgcacttgttggatgataggcattcaatgatgcagatgtgccttgctagaacatcatgtacta

SEQ ID NO: 71 - DNA, 479 bp, Zea mays
  misc_feature (21)..(21): n is a, c, g, or t
  misc_feature (152)..(152): n is a, c, g, or t
  misc_feature (179)..(179): n is a, c, g, or t
  unsure (1)..(479): unsure at all n locations
tcaccgaggtcctgccatggnggatatgtcgatgctgctgatctttggaataactcattcagtttcacttcctctctttgctgctatcttggcagaaggagccaatctcaagcttataagcttgtcactcttgatgaatcaagtcagatttnatttgcaaggtcttttgctaactcttnctaggtccagttgaacccattcaagtcaattttcttgcagttctgtggcccatcagtggtatcattgatgttcagatccagttttgctgccttccgcgtcatactaaaacttcctctctcacgcctgtctagttggcctggaggcgtcatgcttagcttgtcaagaaacaaatcctctcttcctctttctttctcttgtatatcaaaggtcatgcctcctatctcctttcctctgtgagcggaaagactgattgacaggatatcttgatctttctgtgagccgtcacaggcagttaagca

SEQ ID NO: 72 - DNA, 671 bp, Zea mays
  misc_feature (1)..(3): n is a, c, g, or t
  misc_feature (439)..(439): n is a, c, g, or t
  unsure (1)..(671): unsure at all n locations
nnnacttcggttggactgcctgtactgccgtagcgggctagagcagggagagacaggcagcgacatgttcatccgaacattggatgtgttcctggacgaaagagagatcggttgagacacagttcacaatatgtaaattgatataaatctgacagaaggagaacatacaatgctgcgatcctgcgacttgatgtcgaaggaataggggatgttggtcctggcaagtttcttccaaggatatcaggatctcttaaaggagataaacttctgtatgacgaagtttcaattttcacctgcaagagttgtggtcagcattctgttcgttgccctggtcacttcggtcatattgagttggcaaaaccattgttcaatcctttgctgtttatgagtctgaaaaaccttctccatgtcacgtgtttccattgtcacaagttccgcntgaacaaggaacaggtgagttcattttcatcttgctacttaggttttcattttgggctaagtttttgcatgccactgcacaatcttattgtgatttcactttcttaggttgacagatatgtgaatgaacttgaacttttagtaaagggtgatattgtctgtgctaaaaatttggaagactcagtagaagaagcatatctttccaaggaagatgaaaacatgaacaagaccac

SEQ ID NO: 73 - DNA, 671 bp, Zea mays; identical to SEQ ID NO: 72
  misc_feature (1)..(3): n is a, c, g, or t
  misc_feature (439)..(439): n is a, c, g, or t
  unsure (1)..(671): unsure at all n locations

SEQ ID NO: 74 - DNA, 597 bp, Zea mays
  misc_feature (119)..(119): n is a, c, g, or t
  misc_feature (462)..(462): n is a, c, g, or t
  misc_feature (536)..(536): n is a, c, g, or t
  misc_feature (539)..(539): n is a, c, g, or t
  unsure (1)..(597): unsure at all n locations
tccttgtttcgatcattccaatcgcattctcgacaggagagaactccagagattcagatttgataactggcagacggttcaccaaagcgggaaaggaaccctctgtttggagcactgtncgcctcttccactggtcttctagaccaccttgtgtttttccattttttgtgaatggtgtatcgaaaagaaaacggtcaaaaacacgtgcacgaacagtaccagtagataaagaaaatattctttccctcctgctacccaagtcctcatcctccatcacaggatcaacagcagtgatctgtaaatagcagaagccaggctgcaactcatcagcgttgacttgtctagagtctggaattatgtgtaaagtgtgacttccatctattttagcctcatatatatgactaagcttctccataatatcaccaagacgtacatcccgtggttctctaaatacatactccnttttattgagcttgccaaaacgctcaccatagaaaccaactcggtagtatgtggcatcaatgaatggtataggnctngcctcctgttcaagaattgactcatagatgtttgtgagcgatgtgtggcatttggcca

SEQ ID NO: 75 - DNA, 500 bp, Zea mays
aatccgcaactgcaattttctctgaatctgcaatataggaatatatatatatatagtgttaggataaagcaagcttcattggcattaatattaatgttgggcaaaatcacttagggcccgttcgtttgtgtccaggaatggacacaggattcgttccagcttatcaaaacttatataaattagagaaacaatccgactaggaatcgttacaggcctccaatccgtgaaaaccaaacagggccttgtggaatcaacactaactgaatttagaattagtacctcaagctgttcatgaagccgtttctggacttccatctgaaggcgcagtgcttcagtaagatccatgctcctatacaagaatgcccaatatcatggaagagtattaaccaagaagtaacagacaaagatgatcgtaaaatgcactttaacatataggaaaaccttcaaattagattttatgtttcaaaagaaacaacaaaagtgaatgcaatggctcaatg

SEQ ID NO: 76 - DNA, 327 bp, Zea mays
  misc_feature (162)..(162): n is a, c, g, or t
  unsure (1)..(327): unsure at all n locations
atcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaagtatgtctnccctattggcatttcccctcaaatagtttaagttatgaaccctacatcacatcatctaatgcatgtgtttatttatcttttcttattcctattcagaagctactcctaagggtgtgctaaagcttatgaaagttgatggtttgactatatatcatgtcaaaagcc

SEQ ID NO: 77 - DNA, 512 bp, Zea mays
  misc_feature (14)..(19): n is a, c, g, or t
  misc_feature (21)..(26): n is a, c, g, or t
  misc_feature (28)..(29): n is a, c, g, or t
  misc_feature (32)..(33): n is a, c, g, or t
  misc_feature (35)..(38): n is a, c, g, or t
  misc_feature (41)..(42): n is a, c, g, or t
  misc_feature (44)..(46): n is a, c, g, or t
  misc_feature (48)..(52): n is a, c, g, or t
  misc_feature (55)..(57): n is a, c, g, or t
  misc_feature (101)..(101): n is a, c, g, or t
  misc_feature (145)..(145): n is a, c, g, or t
  misc_feature (148)..(148): n is a, c, g, or t
  misc_feature (151)..(151): n is a, c, g, or t
  misc_feature (204)..(204): n is a, c, g, or t
  misc_feature (277)..(277): n is a, c, g, or t
  misc_feature (456)..(456): n is a, c, g, or t
  misc_feature (461)..(461): n is a, c, g, or t
  misc_feature (478)..(478): n is a, c, g, or t
  misc_feature (497)..(497): n is a, c, g, or t
  misc_feature (499)..(507): n is a, c, g, or t
  misc_feature (509)..(509): n is a, c, g, or t
  misc_feature (511)..(511): n is a, c, g, or t
  unsure (1)..(512): unsure at all n locations
ctcatgggctgtcnnnnnntnnnnnntnnctnncnnnntcnnannntnnnnnctnnntaatcttgcttacgtacgtatactttacattctataatctactngcaggattacattttgaagaagaaaaactctacaacatatgggnganganagaagaataaactgtagcgcttacatgcatgctcaaaatagcctcataaaccnaatactatctgggatgctagtccagctcctcccatttctgacgtgaatttctggaccgcgtgaagctgtctanttctcttcagatcccgtgccgtttgtctccggaccatcactcctcacagcttgtgctgcattgctcctgtctataataatctgtcacaccaaaactgcaggctttaaaaggcccagacgcattccgggcgcctctacagcccaattaaaaacctcatttcttctctccaggaaagaggnattcnatttcaggacgaacggncacagatgcatggatgcangnnnnnnnnnancna

SEQ ID NO: 78 - DNA, 767 bp, Zea mays
  misc_feature (10)..(12): n is a, c, g, or t
  misc_feature (253)..(291): n is a, c, g, or t
  misc_feature (321)..(491): n is a, c, g, or t
  unsure (1)..(767): unsure at all n locations
gaggcctgannnctgccaccgcgatttccactcccaggctatggacgcacagccgcagttcctgccagcagtgaattggacacctgaagactgccaccgcgagttccactctcaggctatggacgtgcagccgcaatttctagccaggtgggagtcgaacgcctgtagctaagactgccgccgcaacatgcatcaacgccctgtagccctgtacgcctgtagctggtcgtggtggcgaggtacagcatgtgannnnnnnnnnnnnnnnnnnnnnnnnnnnnnnnnnnnnnntggtcggtgggaggataggatggcgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgatcgtcaacaatgttttctctatgtttcgtttatcaacaaagctattaaggaatcactagcggtatcagcttgttaggaaaccactagcactattgtccactgttttactgccaaatattcatctatcactacgcgtacttaaacatatgtattttaacaaaaacaagttcgctagcatccattactgcctccagacagacccgaatccaaaaaaaaactgcgacaataagaacagattaccgtatctcgttgaagccgcgcgccgtgca

SEQ ID NO: 79 - DNA, 705 bp, Zea mays
  misc_feature (214)..(214): n is a, c, g, or t
  misc_feature (531)..(531): n is a, c, g, or t
  misc_feature (572)..(572): n is a, c, g, or t
  misc_feature (598)..(598): n is a, c, g, or t
  unsure (1)..(705): unsure at all n locations
aggagaagataaagctgccaacatatttatctagtgaagttcactcaatgttgaaaggagtaagttgctgctatgtctaccttgctcctatgcattttgttcaaccagctttgtgttattgttaaaacctactgtttacggccatcactctaccattcgatctcataatgtttccattttttgtggataatcatcctgccatgatcatgtcatntttctcaacactgttatttatttcagttattgcacaaagaagctggcagaaggctgggaagcggaccaggcggcagtgacgaaatcaagaaccacaagtggttcaagtctgtaaactggaagaggctggaggcccggcagatcgagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttcctccagaagccgagtccncttggctaaagaactacttccgtgatctgatatctaccccngagttcaaataactatctttgagtcngaatcctatgtatttcttcaagacattagtgatgggaatctaaccttattgttgtgttgtgggtaggccagccaagcgcctattgcttgagaacaacagctggcaag

SEQ ID NO: 80 - DNA, 446 bp, Zea mays
  misc_feature (47)..(47): n is a, c, g, or t
  misc_feature (284)..(284): n is a, c, g, or t
  misc_feature (289)..(290): n is a, c, g, or t
  misc_feature (295)..(295): n is a, c, g, or t
  misc_feature (297)..(298): n is a, c, g, or t
  misc_feature (301)..(301): n is a, c, g, or t
  misc_feature (304)..(304): n is a, c, g, or t
  misc_feature (306)..(308): n is a, c, g, or t
  misc_feature (341)..(341): n is a, c, g, or t
  unsure (1)..(446): unsure at all n locations
gtttgaagcggacatggattacacaatgcttgagaaagggcactcgncagagatagtgacagcagccggcagcaacttgggtaaggttttcgacagcgctttaagggatcaggcaacagtttgaagcagacatcagagtggagcatgtgacagcatagttctgattctggaggctcccctctcttgtgacttgtatatcctaccctactggtccagattggcagcctaataactcacctcaaatcccaattgatcagacccacccacaacaacctagtcacctnggcanncccancnnaancanannnctagtcacaatttattgactgactaagcagacnacgaggaacctaggcaaacctaatagcctatcaacttcaagataccaattaggttgactaatcacaattacaattaacttgtaaacactgtctgtatatttgggt

SEQ ID NO: 81 - DNA, 688 bp, Zea mays
  misc_feature (43)..(43): n is a, c, g, or t
  misc_feature (119)..(119): n is a, c, g, or t
  misc_feature (137)..(137): n is a, c, g, or t
  misc_feature (190)..(190): n is a, c, g, or t
  misc_feature (240)..(240): n is a, c, g, or t
  misc_feature (266)..(266): n is a, c, g, or t
  misc_feature (287)..(287): n is a, c, g, or t
  misc_feature (361)..(361): n is a, c, g, or t
  misc_feature (425)..(425): n is a, c, g, or t
  misc_feature (542)..(542): n is a, c, g, or t
  misc_feature (599)..(599): n is a, c, g, or t
  misc_feature (630)..(630): n is a, c, g, or t
  misc_feature (671)..(671): n is a, c, g, or t
  unsure (1)..(688): unsure at all n locations
agaactttaacttgcttaagggatactgacttactgaattccngagcacaatgctccagatcagcagaagaaagtgagccatgcttattcttcaacccaaacttcatgcagatagtgtnagcagcaaaattaccacnaaagggtgtaacttggccacacgcctggatcttcttggaacaaaatttggtgnaatattctttctggtcttcggcttaggagatgctggtgtcgacaaaatanttgataggggtttggtgaccatctcnataaagttgttagctatgtcncaggtattaacctcctgaagctgaagcttgggccgaatccttctgtgatagactttcagtattttgctagatcnagatcgggagacctgaacagaaggtaatgctggggagtgaagaaccactgcacccacagcaccnaaaccatcaacgcacttctcaatctgaggcattccgaagtcctgagctgacacggtcaaatttcccaacaagtgctcgaccaatgcattagaagaaacaccaggagcctggaaccangcagacttaactgaggcatggacctcaaccgcagcatgaaccggtgtaggagttatnaacgaaatgaatggcgccattactgtagcancagttaaagaacatgccaggatgtcacaattcaaaaaatcnggtgacataactgcagg

SEQ ID NO: 82 - DNA, 770 bp, Zea mays
  misc_feature (10)..(10): n is a, c, g, or t
  misc_feature (62)..(62): n is a, c, g, or t
  misc_feature (87)..(87): n is a, c, g, or t
  misc_feature (94)..(94): n is a, c, g, or t
  misc_feature (111)..(111): n is a, c, g, or t
  misc_feature (115)..(115): n is a, c, g, or t
  misc_feature (275)..(275): n is a, c, g, or t
  misc_feature (277)..(277): n is a, c, g, or t
  misc_feature (364)..(419): n is a, c, g, or t
  misc_feature (455)..(455): n is a, c, g, or t
  unsure (1)..(770): unsure at all n locations
ggcttctttnccaagcaacaaggatgccccctcttgtgtctttagatggaagaaaagcaaantcaccaaactcagagccaaggcagnaagccanatcccagtgattaaaangagngtttggtttcctgaacacacacaatggaggggtttacacagctcaccaaggaccttagagtatccttttgatgaggatcattcaaacctctgacgttccatacaagaataggagaattattcatcgggataatcaacaaccgaccaagaaaagggggggngngtctgtctaagcagaaaccaacaaccctcccagaggttcaacacggaactcatcagggatctcccacccaaacaaagacgccagagnnnnnnnnnnnnnnnnnnnnnnnnnnnnnnnnnnnnnnnnnnnnnnnnnnnnnnnnggaaggccttagaaggccagacatgatacaaaggancgccaccttatggcggccagacacaagcatacaaataagaatccatggaaaaaactaggaacaccagagggttaaggtcacagacttctaatgcctactgccccggccatgccccacaactgagcatcttgctgaatatggagcaggaccaagctgctgcaaggggaggcaccatcaaacacacaggcattcctgtgtttccacagccaccaggctaccaagatgacattggaattgaagcctttttctggactttaggcaccttgctttcagccaccccccaccaatcctggaaaacaatgtcagcaatcccag

SEQ ID NO: 83 - DNA, 590 bp, Zea mays
  misc_feature (155)..(155): n is a, c, g, or t
  misc_feature (168)..(169): n is a, c, g, or t
  misc_feature (184)..(185): n is a, c, g, or t
  misc_feature (218)..(218): n is a, c, g, or t
  misc_feature (229)..(229): n is a, c, g, or t
  misc_feature (232)..(232): n is a, c, g, or t
  misc_feature (262)..(262): n is a, c, g, or t
  misc_feature (266)..(266): n is a, c, g, or t
  misc_feature (272)..(272): n is a, c, g, or t
  misc_feature (274)..(274): n is a, c, g, or t
  misc_feature (279)..(279): n is a, c, g, or t
  misc_feature (284)..(304): n is a, c, g, or t
  misc_feature (306)..(306): n is a, c, g, or t
  misc_feature (315)..(315): n is a, c, g, or t
  misc_feature (323)..(323): n is a, c, g, or t
  misc_feature (362)..(362): n is a, c, g, or t
  misc_feature (380)..(380): n is a, c, g, or t
  misc_feature (423)..(423): n is a, c, g, or t
  misc_feature (434)..(435): n is a, c, g, or t
  misc_feature (452)..(460): n is a, c, g, or t
  misc_feature (462)..(469): n is a, c, g, or t
  misc_feature (472)..(505): n is a, c, g, or t
  misc_feature (507)..(527): n is a, c, g, or t
  misc_feature (530)..(539): n is a, c, g, or t
  misc_feature (549)..(553): n is a, c, g, or t
  misc_feature (589)..(589): n is a, c, g, or t
  unsure (1)..(590): unsure at all n locations
actccctctttctcagtctctgacatatacaaacggtgagcacgcacaagcactgactgaaagttaaacacatgattttgcaggttgcgactgacaaatgtatcatggcattcctcttcctgatcgttttgggtgtgattgctatcattgttgtnaaggtatgtatannatgtttgtcatcagnntgcagaagaataccttcagttcaacattcttcnaggagaactcntgncatctccgtatattattctacaacaaatgngagncgaatnanaagcntaacnnnnnnnnnnnnnnnnnnnnncntgcagatcntccatccnaataacaaaaacattcgagacattccagggctggccccncctgctcaaaactatcanattcacaacaggagattgttgtgggcagaagcttccataggcntgtgatggctnngaatgtaggcttcatgnnnnnnnnncnnnnnnnnaannnnnnnnnnnnnnnnnnnnnnnnnnnnnnnnnnannnnnnnnnnnnnnnnnnnnntcnnnnnnnnnntgttaactcnnnnncctaggtctgtattcctgcgtctggtgtttgtacanc

SEQ ID NO: 84 - DNA, 589 bp, Zea mays
agcacaaactgttgagactggagctcaaactgctgcgacattaacacagcaaacagagcaaatgaagagaattggtaatgagctagatactgtccacttctcactgaagaaagctagccaactagtgaaggagattggtcgccaggttgcgactgacaaatgtatcatggcattcctctttctgatcgttttgggtgtgattgctatcattgttgttaagatcgtccatccgaataacaaaaacattcgagacattccagggctggccccgcctgctcaaaactatcagattcacaacaggagattgttgtgggcagaagcttccataggcatgtgatggctctgaatgtaggcttcatgtggacgcactgcctgcgaagcagcagctatccatagggcgaaagatacatagtaacaattctttgtgcctgtatatctattttgtcttgttaactccgagccctaggtctgtattcctgcgtctggtgtttgtacaccgctggccgtttggctgtgtatatggtacagagatgagatcttaaaaccaaaccagtaattatgacgaatacttgaaagagctacagtaccg

SEQ ID NO: 85 - DNA, 649 bp, Zea mays
  misc_feature (45)..(45): n is a, c, g, or t
  misc_feature (62)..(65): n is a, c, g, or t
  misc_feature (83)..(83): n is a, c, g, or t
  misc_feature (98)..(98): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (123)..(123): n is a, c, g, or t
  misc_feature (159)..(160): n is a, c, g, or t
  misc_feature (369)..(369): n is a, c, g, or t
  misc_feature (396)..(396): n is a, c, g, or t
  misc_feature (411)..(411): n is a, c, g, or t
  misc_feature (418)..(418): n is a, c, g, or t
  misc_feature (420)..(420): n is a, c, g, or t
  misc_feature (578)..(588): n is a, c, g, or t
  misc_feature (594)..(597): n is a, c, g, or t
  misc_feature (600)..(602): n is a, c, g, or t
  misc_feature (604)..(605): n is a, c, g, or t
  misc_feature (621)..(622): n is a, c, g, or t
  misc_feature (626)..(626): n is a, c, g, or t
  misc_feature (632)..(647): n is a, c, g, or t
  unsure (1)..(649): unsure at all n locations
gtcgtgctgacgttcggcggccaaatgcccgttgtcaaggtaacntacctacccatctacgnnnnccgcacgccacacaaaancacgtgaatcgaaantcccnttncnttggaaggaactggncggatggcttttatgtgttcgactgttcgtgcgccnnaggtcggtaggatggccggccaattcgcgaagccgaggtcggacgcgttcgaggagaggggcggcgtgaagctgcccagctaccggggcgacatcatcaacggcgaggctttcgacgagaagagccgcgtccccgacccacagaggatgctcaaggcgtactaccaatccgcttccaagctcaacctgctccgcgccttcgccaccggnggctacgcggacatccaacgcgtgacncagtggaaccttganttcactnancacagcgagcagggcgacaggtgaaataaaatcttgcacgcactcactcactgattgcagttatattatatgtcatgggtgactgagtttcattattcagttatgttatatgtcccaaaatttcatcctttttttatgacatgcatgactgagtttgnnnnnnnnnnnaattgnnnnatnnngnngatgatgcccttgganncatnggtgcnnnnnnnnnnnnnnnnga

SEQ ID NO: 86 - DNA, 1287 bp, Zea mays
  misc_feature (1248)..(1270): n is a, c, g, or t
  unsure (1)..(1287): unsure at all n locations
tgctgccgccgctactccagttccactccacctcacgagtctcacacacctcccccctcctttttagggagagaaagcaacgaaacgccgagagaggcgtgcgagcgggagcaaggagatggagcgggcggcgccggtgaggagctcccacacctccacggccgacctactcgcgtggccgcagccccagggccccgccccagcaacgccgttgacgtcgagccggcccggtcagccgtcggaggctatcaggaaggtggtgttcgggggtcaggtcaccgaggaggaggccgacagcctcaccaagaggaagccgtgctccgcgcccaagtggaaggagatgactgggagcggcattttcgctgccgggagcaatggagacgctggggaggcagctgctgccgcgaagcccgcccgaacctcctcgcgccaggcgagcagtactgtaagccacatctcgttcgctgaggatggaaccgatcctcccaaaaagcccacatcagtagctgaggtggcaaagcagcgtgagcttagtggcactcttcaaagcgagacggatagtaagacgaagaagcagatctcaaatgcaaagtccaaggagctcagcggccacgacatctttgctgatactctggattccaggtctaacagggcaaggaacccatcgaacggcagcacagcctcacacgcacctgccaaaaatacaaacgccagcaccttctcgtttggagatgccaacactgacagcacgccaaagacggcaaggaagataaccggcaagaaggtcaacgacctcaccggcaacgacatcttcaagggagacgcgccgccagcttctgcagagaagcatctgagcaccgcgaagctgaaggagatcactggaagcaacatttttgcagatgggaaggaaccaatccgcgagcgtgtgggcggaaaccgcaagcctcctggcggtgaaagcactatcgcgctgatttagcataatccgggactcagtgtcgacccctagaggaggatttccaccagtaccaggcagcaggctgttggatcgtcagtttggtgtcttgttcctgatcaaggtgcggcagtgaagagccccgttttagtcttgatgatgtttattaactgttggtgtgtgcatgtttggtttggctgtgagatacccatgccgtcctcatcatggcagtgtgtagtgtttacggttgatgtgtttttacaaataatagctcgagtctgaaccaaaaaaannnnnnnnnnnnnnnnnnnnnnnaaaaacccccaacccag

SEQ ID NO: 87 - DNA, 760 bp, Zea mays
tgctgcaccctctcgttgaagctgatggactgcagcagcttgcgcaggcgggacggcgtggaggtctccttgccgccaccgccgtcgccgtcgccgtcgtcgtcgtctgcggcgtcgctcttgtccttgatgaggaccgccttgaggccgaaggaggacggcatgctctgctggctccgacgtccgtcgcctttcagcgcaaggatgtcgggtaaaggcacgccgcggcatatgtctccgatgcgagagagcgcgtcggcgaagctggacgcgctcgcgtattgctgcttctccgcctgctcttcgtagtcttcgtcgctgtctgcaggagggggaggggtagcagagcacagtcacagtgtggccattcctggttcatactaggcattagatgtttcttgctctagcactattcttgttacctccatcgacgctcttgaattcgtcgtcagaatcatcttcgaggatgctgacagaatcgaaccaggcgtcttcgttgctgcaacctacaacggtatgaggaactctggttgatctgtcgccttctcgctcatcagcttaaattaaactctctctctctctctctcgctcttacctttagagtccctctggctgtggtgccattccatctgcgtgaggtggaacgtcttggagtgctccgacttgccccggttggccgtctccacgtgcacgatctcgctcatggagaagccggtcatgcggcctctgctggcatcgcccaggggtaccgagtccgaat

SEQ ID NO: 88 - DNA, 392 bp, Zea mays
gctgagaaaaagcgtaaagaagaggaggaagctgtagcaagggcatcccaagaagcagctgagaaggaagctgctcttgcaaggaggaggcaagagaaggccatggctcttggagctgaacctgagaaaggaccaggtgttactcgggtatgtgatgtctaaccctctatgcttgtgtctttaaactacctttttccaattcttactgcaagatagcatgcttcatgttgtgccgatttttaaggatttgtctatttgagtgcgtcaaatatcactgttatgcctgcaaatatctgtttcatgtacgatatatttacagtgattgcaatgaatccttcgttactatctgagttaattgttagttttggctacgtagtgcctgaatttgatat

SEQ ID NO: 89 - DNA, 724 bp, Zea mays
  misc_feature (131)..(131): n is a, c, g, or t
  misc_feature (180)..(180): n is a, c, g, or t
  misc_feature (262)..(262): n is a, c, g, or t
  misc_feature (336)..(336): n is a, c, g, or t
  misc_feature (341)..(341): n is a, c, g, or t
  misc_feature (388)..(388): n is a, c, g, or t
  misc_feature (551)..(552): n is a, c, g, or t
  misc_feature (601)..(601): n is a, c, g, or t
  misc_feature (618)..(623): n is a, c, g, or t
  misc_feature (627)..(627): n is a, c, g, or t
  misc_feature (636)..(636): n is a, c, g, or t
  misc_feature (653)..(653): n is a, c, g, or t
  misc_feature (655)..(656): n is a, c, g, or t
  misc_feature (659)..(660): n is a, c, g, or t
  misc_feature (668)..(677): n is a, c, g, or t
  misc_feature (681)..(684): n is a, c, g, or t
  misc_feature (688)..(691): n is a, c, g, or t
  misc_feature (693)..(696): n is a, c, g, or t
  misc_feature (698)..(723): n is a, c, g, or t
  unsure (1)..(724): unsure at all n locations
aagagatgtaaactttgctgttgctgattacttcctcccaacaacaagcaactctgttgacagttgaccacagcaaagaagcagacagatcattttcttctactgctagtatttaatttaatctattagantgcaaggtagcatagcaaccaacaaaccagtcactgatacatatatggngaccgcagctctgttcttatagatcatacagcacacctgcactacctgcatgactgcatgatgtgaagtaggcagccttctnctagccctcgactaatcagactacattctcctctccccggttcacaaaccttgcccgatggttgtgacctgtgnctgangaaccaccacaaaagcagccaaatagaacagtatctttgcaccgacngagacatcagtaaacttcaggtgcctccctcaggggtacgttcatgctgctttccattgtttgccacccaagcccagagctgtcgctctgcatcattgtgacgaactcgccatagttggtctggccgtcctgaaaatttacagaatgacaagttcacagaccnnattgtcagcagggaatttttttccctacatgcttattcatgtcttaaantagatatgaaaatagtnnnnnntacnaaaaaaatnaatcatatatgacaaangnnctnnagatctcnnnnnnnnnncatnnnnaaannnnannnntnnnnnnnnnnnnnnnnnnnnnnnnnnt

SEQ ID NO: 90 - DNA, 686 bp, Zea mays
  misc_feature (69)..(69): n is a, c, g, or t
  misc_feature (178)..(178): n is a, c, g, or t
  misc_feature (222)..(222): n is a, c, g, or t
  misc_feature (249)..(249): n is a, c, g, or t
  misc_feature (372)..(372): n is a, c, g, or t
  misc_feature (395)..(395): n is a, c, g, or t
  misc_feature (482)..(482): n is a, c, g, or t
  misc_feature (503)..(503): n is a, c, g, or t
  misc_feature (624)..(625): n is a, c, g, or t
  misc_feature (639)..(647): n is a, c, g, or t
  misc_feature (649)..(657): n is a, c, g, or t
  misc_feature (676)..(684): n is a, c, g, or t
  unsure (1)..(686): unsure at all n locations
gcagctgaaaaaattgacagagcatcatcatctgaggtcagcaaccctgatactagtacatcagaaacnggttctccattctatcagcttagaacagatgctacaaaacttgttgcacaaacatttcaaagagggcgaagaaatctttggcagctggcaacaagtcgcttatctgttntattatctagttcggctgtttgttcaactagcacataccaattnctgaagaattatgaagatcttgccatnttcattttggctggcgaagcattttgtggatttgaagctagtgagttccgccagaagttgaagactgtctgtttgaactacatggtgtcctttcaccggcaaaatgtatatgtatgtcaatanctctgactcggttcttaatgatnagtgctcaaagttcaaacatgtgaattttgaactgctatcatctttttaactgcttaaaatgtgtatgcagttcatgacgtgtttgnagtctttacgaacattcttcntatttcttttcttttcttcattggtagtgctggtttcacagtagcccatttttgtaactgattttgatataagctaccagtgcttttatgtttctacaaaaggagtttgcagctgatatgnncattagtcagtgcnnnnnnnnnannnnnnnnngcattgatatgcaccatannnnnnnnngt

SEQ ID NO: 91 - DNA, 791 bp, Zea mays
  misc_feature (770)..(770): n is a, c, g, or t
  misc_feature (780)..(780): n is a, c, g, or t
  unsure (1)..(791): unsure at all n locations
gcgcactcgcggctgctggcggtgtgcgcgcggtgcgcggagcacggcatcccgctgctggtggacgcggagtacgcgacggtgcagccggccatcgactacttcacgctggtgggcgcgctggcgttcaacgacgccggcgcggcggacggcgggcgacccatcgtgcacggcaccatccaggcgtacctccgcgacgcgcgggaccggctggaggccatggtgcgcggcgcggagcgggagcgcgtgcgcctggggctcaaggtcgtgcgcggcgcgtacctgacccgcgaggcccggctcgcggccgcgctcggcgtgccgtcgcccgtgcacggcagcatccaggagacccacgactgctacaacggctgcgccgccttcctcctcgaccgcgtgcgccgcgggtccgcctccgtcatgctcgccacccacaacgtggagtcaggtagctggctgcccgcgccgcaaacccctcgtcctgtcttcctgcacaactggttactgatgggatacggtggtcgtgtgttccttgctgatcctactaggccaactcgcggcggcgcgtgcccaggagctggggatccccaagggagaccgcaacctgcaattcgcgcagctgatgggcatggcggacgggctgtcgctgagcctccgcaacgccgggttccaggtcagcaagtacctgccgtacgggccggtggagcagatcatcccctacctcatcaggcgcgccgaggagaacaggggcctcctctccgcctcctccntcgacaggcngctgctccggt

SEQ ID NO: 92 - DNA, 1083 bp, Zea mays
  misc_feature (1070)..(1074): n is a, c, g, or t
  unsure (1)..(1083): unsure at all n locations
tgcagatttagtgaattttccattcacagatccacagcatttgcagctacgtgcacagatatttgtttatggagctcttatgtgagttataattcttttaagttactaatatcccaaatgtatgaatccttatagccttatctcacatgcaccaattataaatctgtgataaacccaatgcacatatcacctgattcttccatttctgctccttcttaattgtaccctaaccagtgcagtaaacttgtcacatatctaactctagcggtaagtgtgataaactccaatgcacatatcacctgattcttccatttctgccccttcttaattgcaccctaaccagtgcagtaaacttgtcacatatctaactctagcggtaagtgatgagcaatagtgccaccctttatcttaatgcttgtgcccaagacaaaattgatatatgcgattggttggagtatttatttgtataatgtgatataatataagttatttttctttgagcagtcaaggaacaccaccaggagaggcttacatggtggcggcttttggagaacctggtttgtctgatttcactgtttaatgtagtcctcttccgcgctctatgtatcttatagattttgtgttacatgaacagtaggtggtggcaaacctacatgggaggctgcttggcgagctgcttttgaaagatttcagtataaaaaatcacctcatgtcagtttagagactcccacaagttcacttataggtaaatatatgaatgacagtggaacaatattgccagacatatatttttttctatttttttctgaccagccgagcttgcaggtagttctgtgcctgagaaagctagcaaaggtacagcaattacaactgtgccagctagcaaaaaagttggtaaaactgtggcgccagcacatcctgctgtaaccctacactctccaacttctgattttccttttggtagttctacatttaatctgcaacgaggcactcatctggattttagccaggcagtatcaccatttgcgtataattcacacatgagacatccgtctcctggtgttgccccnnnnnatacgcaga

SEQ ID NO: 93 - DNA, 866 bp, Zea mays
  misc_feature (17)..(17): n is a, c, g, or t
  misc_feature (300)..(300): n is a, c, g, or t
  misc_feature (431)..(431): n is a, c, g, or t
  misc_feature (492)..(492): n is a, c, g, or t
  misc_feature (711)..(711): n is a, c, g, or t
  misc_feature (738)..(738): n is a, c, g, or t
  misc_feature (791)..(797): n is a, c, g, or t
  misc_feature (826)..(826): n is a, c, g, or t
  unsure (1)..(866): unsure at all n locations
ataagcgcccagttgangccctcaaagaaggggtgctgctttatctccgcggcgcccctcttcacgcccagccggctctggggctccttggccagcaggcctctgatcaggtccctgctcgcgttgctcgtgccggggcagtccgggaacctgagctgctggccgacgacgttgaacagcgtggcgcggttcgtctgccccttgaacggcgtcttgccgtacatgagctcgtgcaggaagatgccgaacgtccaccagtccaccgcgctgccgtggccctcgcccttgatgatctccggngccaggtactcgtgcgtccccacgaacgacatggaccgcgcccccgtcggctccacgacgagctccggcaggcccgtgggagcctgctgctgcctgggctcgccgcccttggatttggatttcttggcgcngctgctcttcttgctcctctggccgaagagcttgggcatgaagcatgtgggctggatgcangcagcctgcgcgttcctggagtcggagttcagggaagatctcaccagcgtcggcgacaccgcgcaacgaagggagaggtcgaagtcggagatcatgatgtggccatcttctctcacgagcacgttctccggcttcagatctctgtagaccactccaagcatatgcaggtactccagcgcaaggagcacttctgcggcgtaaaacctggcagaaaagaanaaaaaaaaagagagagatcatacaccncagaattggcgaccattctgtttattcgaagtttcagactccggcaaagaatnnnnnnnagttcaagaagcaatgatgaaaatgcgcnaacgatataggagtaataaacaatgtgtctatcctaatct

SEQ ID NO: 94 - DNA, 728 bp, Zea mays
  misc_feature (615)..(617): n is a, c, g, or t
  misc_feature (619)..(621): n is a, c, g, or t
  misc_feature (632)..(632): n is a, c, g, or t
  misc_feature (635)..(639): n is a, c, g, or t
  misc_feature (654)..(654): n is a, c, g, or t
  misc_feature (676)..(679): n is a, c, g, or t
  misc_feature (683)..(684): n is a, c, g, or t
  misc_feature (688)..(688): n is a, c, g, or t
  misc_feature (700)..(701): n is a, c, g, or t
  misc_feature (707)..(709): n is a, c, g, or t
  misc_feature (712)..(713): n is a, c, g, or t
  misc_feature (716)..(725): n is a, c, g, or t
  unsure (1)..(728): unsure at all n locations
cctcgctccaacgcaaattgaacctgagcttcatgtgaatctctgggtgcaaatgacatggttaatacatttctgtccattagataagctccgaagcttgcaacctgtatgtggtcagaactgttactcccagctatggatggatcaaagtaattaaggctagtttacaagaaaatgaagataagtcttactaaaaagatcaatatctaaatgccttggaactataaactatgaagtatataagacacatcttaaagggagtaaaatataacaagatctggtgagagagcataccccacatccagtatcaagtgcagttctgatagtgccatcagcgagtgggatgatggatgcaagttcatcaaggtaagcattcgctccattgggaaacattgttcctcctcctggaaatttgaacacatctccctgatattggatccagttctgaacagctttctcaactgtcagactcttatacggagcatttgcatatggaacatagtcacggctcttgggccaagagaaaggggtgacatatccttttggtgctgggatgagacaatgcagtttctcattctctacaggacaatgcctttctctgtatgtcatgttttnnntnnnaaaggccattnctnnnnnctggtcttgacaagnagtatagtcactgtatcggatnnnncatnnctcnatcattttattnnacatgnnnaanngannnnnnnnnntta

SEQ ID NO: 95 - DNA, 554 bp, Zea mays
  misc_feature (466)..(471): n is a, c, g, or t
  misc_feature (486)..(490): n is a, c, g, or t
  misc_feature (494)..(496): n is a, c, g, or t
  misc_feature (517)..(519): n is a, c, g, or t
  misc_feature (522)..(524): n is a, c, g, or t
  misc_feature (526)..(526): n is a, c, g, or t
  misc_feature (528)..(531): n is a, c, g, or t
  misc_feature (533)..(533): n is a, c, g, or t
  misc_feature (535)..(543): n is a, c, g, or t
  misc_feature (545)..(550): n is a, c, g, or t
  unsure (1)..(554): unsure at all n locations
ttaatacctgggtaggagtcaaaacaggtactcttacagaaagtgcccatcgcagttcccgtatatcccgtaaccttttccagtcagacataccagaagcccaacattttattgtccaatcaattgacttctttgaccacagccttcttattgcatccttttcaagtggcccaacttgtgtgccatctttatcaatgtacatccactcttttgaaggttccataaatgcagttgccgcgatgaggttagattgcaaaggaatagctgtccgttcggatgtttcatgtgcaacagtaagcaaatcaacagccaaaacacagcctccaaccaaaacacatgcttcaacatttgaaaggtcattcatcaaggcctataaaaacaaggaaaaagagcgagaaaatttatcagcatttgagggtatgtcatcagcagatccataatagtaaattggttcttgaaaatattnnnnnngattaatgtccatgnnnnnagcnnntgcctagatactcatcagttnnnctnnnantnnnnantnnnnnnnnnannnnnncata

SEQ ID NO: 96 - DNA, 710 bp, Zea mays
  misc_feature (13)..(14): n is a, c, g, or t
  misc_feature (152)..(152): n is a, c, g, or t
  misc_feature (218)..(218): n is a, c, g, or t
  misc_feature (622)..(622): n is a, c, g, or t
  misc_feature (660)..(663): n is a, c, g, or t
  misc_feature (668)..(669): n is a, c, g, or t
  misc_feature (675)..(683): n is a, c, g, or t
  misc_feature (686)..(686): n is a, c, g, or t
  misc_feature (690)..(694): n is a, c, g, or t
  misc_feature (709)..(709): n is a, c, g, or t
  unsure (1)..(710): unsure at all n locations
tgcatgcctgcannaagcatgacatcgaacccaggaacccggacagctacttcaacctgaggagagatcccttcaagaacaaggtgaagccagacttcgtcaaggacaggaggcgcgtcaagcgtgagtacgacgagttcaaggtccgtgtnaatggcttgccagatgccatccgccgccgctccgacgcgtaccacgcccgcgaagagatccaggcnatgaatcttcagagggaaaaactgaagggcggcggtgacgagccgccgttcgaaccggtgaagattcccaaggcgacatggatggctgacggcactcactggcccggcacctggctccaaccttcgcaggatcatgctcgaggtgatcacgcaggaatcatacaggtgtgtcttgtctgtcgtccacttgtatctcaattcttcattcaccacaaatcatcatgtatctaacgtctgcatattcctcaggtcatgctgaaaccaccaagcgacatgcccaccaccatgtacgacgcggcttccaagacacctcttgacttggcaggagtggacacccggctcccaatgctggtgtacatgtcgagggagaagcgcccaggatacgaccacaacaagaaagcagncgcgatgaacgcactggtccgcgcatcggcgatcatgnnnnacggnncgttcnnnnnnnnnctngacnnnnnccactacatctacanc

SEQ ID NO: 97 - DNA, 709 bp, Zea mays
  misc_feature (532)..(532): n is a, c, g, or t
  misc_feature (554)..(554): n is a, c, g, or t
  misc_feature (586)..(588): n is a, c, g, or t
  misc_feature (590)..(590): n is a, c, g, or t
  misc_feature (613)..(616): n is a, c, g, or t
  misc_feature (621)..(623): n is a, c, g, or t
  misc_feature (645)..(645): n is a, c, g, or t
  misc_feature (654)..(656): n is a, c, g, or t
  misc_feature (663)..(663): n is a, c, g, or t
  misc_feature (672)..(676): n is a, c, g, or t
  misc_feature (678)..(678): n is a, c, g, or t
  misc_feature (680)..(680): n is a, c, g, or t
  misc_feature (682)..(682): n is a, c, g, or t
  misc_feature (688)..(689): n is a, c, g, or t
  misc_feature (694)..(697): n is a, c, g, or t
  misc_feature (699)..(701): n is a, c, g, or t
  misc_feature (704)..(705): n is a, c, g, or t
  unsure (1)..(709): unsure at all n locations
ctttcatccagtaacggtatcctgactggtttgggacaactttctggtgtaattgaagagggctattttacacgaatgtctttgctgttgttttctaaggcatgtctttattctaatcctgaagatatcgctttgatacctgaatgtgtttggcagaagttggaaaacatgcaaacatcaactggtaaaatctgtgataattgaatattcagatttctgaggcagcatatataaatttcattgtattacctatacgatgtcctgcttgttcaagctattttttttcttgttatgtactaggaggttttggatatatggagaaagatctctgcctagctctgtgccaactaaaaagtgaatcagatgctacaactgtactgccccttcccaccccctctccggtacttatgtactgtaacatgtttaccaagtaccgacttcaaatctcttccattaggttgcaaaagttctttctggatgtaatagtcaaccagtcagccctgatttcaagagcatccgtgaatcaatcctncaggtcagtgttttgaatgatnattattatttttggtcttctccatctgtattnnngnttctatttctactttattgcacnnnnatctnnntcagttcattacttgatttatnttctcattnnngatcgtncctgcatannnnncncntnttatannttgcnnnnannntcnntctt

SEQ ID NO: 98 - DNA, 795 bp, Zea mays
  misc_feature (26)..(31): n is a, c, g, or t
  misc_feature (649)..(649): n is a, c, g, or t
  misc_feature (651)..(651): n is a, c, g, or t
  misc_feature (712)..(712): n is a, c, g, or t
  misc_feature (738)..(738): n is a, c, g, or t
  misc_feature (750)..(756): n is a, c, g, or t
  misc_feature (759)..(769): n is a, c, g, or t
  misc_feature (779)..(779): n is a, c, g, or t
  misc_feature (787)..(794): n is a, c, g, or t
  unsure (1)..(795): unsure at all n locations
gtcttctttcgtatagctaagcttannnnnntcttctgtatgcttttagcactgaaagtattgttgggctatgtggtaggttaaaaagattggaaaattcaaggaaacaaaaaggacagacggggtttctacttcagatctcataatgaggatcttgaaggactataaccagtatgtcatgaggaatttagcacggggctactcgaggaaagatcttggtgtgagctatgtcaaggttagacacttccctgatggcacatgctgaagaggtataattagttctgtggaataacatatatcttcctcttattattttcattaggagaaacaattgcaagttaatatgaagatcaataaactgcgggagactgtgaaggcacatcaggaaaaggtaactgttgatttgagattcatcacttgatcagtacttgtcgaggaactagacatattcctttccatagcaggaaagactaaagtaatcagttttactgatatctagcttcgtatgaaatatatcttgcagttgcaaacagtggcaaagactgctggtttgaatcatgaagaatggcttgctaatgcggatcgctgggttgctggtttcctagagaagtttgagcaacactgccacaatatggtatattttttatangnattgtgaagtgttgctaaatgtaattttgaactagttagataagtgatagatgatgatagnagcatatgtcattggtctacttagtngctaactgtcannnnnnnaannnnnnnnnnncctgtctagncttgcctnnnnnnnnt

SEQ ID NO: 99 - DNA, 667 bp, Zea mays
  misc_feature (1)..(4): n is a, c, g, or t
  misc_feature (53)..(53): n is a, c, g, or t
  misc_feature (112)..(112): n is a, c, g, or t
  misc_feature (161)..(161): n is a, c, g, or t
  misc_feature (172)..(172): n is a, c, g, or t
  misc_feature (281)..(281): n is a, c, g, or t
  misc_feature (364)..(364): n is a, c, g, or t
  misc_feature (417)..(417): n is a, c, g, or t
  misc_feature (427)..(427): n is a, c, g, or t
  misc_feature (456)..(456): n is a, c, g, or t
  misc_feature (601)..(601): n is a, c, g, or t
  misc_feature (626)..(628): n is a, c, g, or t
  misc_feature (649)..(649): n is a, c, g, or t
  misc_feature (659)..(661): n is a, c, g, or t
  unsure (1)..(667): unsure at all n locations
nnnngcctcaacgatggcgtgccgtctagctgcccctgccaccgcagtgccgncctcgtcgtcttccgggcacttcttgcagatgcgcagcaacgctgacacgacgagcgcngtggccgcgtcggacacgcagaacattttcttgaccagcacgggcatgncgagtgcgtcngcacgagcacgcgctctgccgtcgcgagacgccagtgctgcatcgagcgcggcgagagccttctcggccgtgctcctgtcagcgtccacgaggagctcgacgagcacgntcacgatccccgccaccgagaggcgcgtcgcggcgctctcgccgctgcgcgcgaggtggtacgcggcgaccaggcacgccctngtggccggcgggcagatggcgtctctgatcgtcttcaccaacactcgggcganggcctcggtnttggcgcacagaccgatcgtacacgcggnacctctgtaaactgaaagcgagatgatctctctgattaccaccacggcttgcagcctcctgtgcaggtcgccgttcgcggcgacggcgaccagccgcgctacggacgcgctcgacgagcccacgaccaggatggcctcttcgtcnattggcatcacgagcaccagcgctnnnagcacagcgtcgagcacatcnatggcgaccnnngcatct

SEQ ID NO: 100 - DNA, 663 bp, Zea mays
  misc_feature (535)..(535): n is a, c, g, or t
  misc_feature (547)..(552): n is a, c, g, or t
  misc_feature (587)..(590): n is a, c, g, or t
  misc_feature (596)..(597): n is a, c, g, or t
  misc_feature (603)..(603): n is a, c, g, or t
  misc_feature (628)..(630): n is a, c, g, or t
  misc_feature (634)..(639): n is a, c, g, or t
  misc_feature (641)..(642): n is a, c, g, or t
  misc_feature (650)..(656): n is a, c, g, or t
  unsure (1)..(663): unsure at all n locations
tgaacaagaacttaataatttggttctcaatgatctttattaccttatacgtggagaactcgaaggacgtcagattagctctggcccttttcaggagttgctcagttttcttcttgggtttagaatttttgaacacaatcccttggagcaactacaaaacacatacctgatggcaaatgacaaatttttatttgatgtggagcacatacatgacgagcttggagttgatctctggactgattcagacaagaggtctaaagaagtagctaaaaaaatgctggatattatgagtaaagcaaatttaatgaagtattatgctgatgcaaaactttctgcattgatgtccttcttgaaatttttatctgtctacaaaggagcggtaatttcatttaccaattgagaactgagatactttctttccttgattatattgttgcaccatactgtttctgttacgaaccatagttcattgatcgctttgggggagactagactgtaggacaaggagttcagtggcttgcatagacaatattcntgctgcccattnnnnnnatctatggctcgtgtttctgaaccaattcttctannnnatcgcnngactgnactggactacatggagacctgaacnnnttcnnnnnnanngcttgagnnnnnnntgctcat

SEQ ID NO: 101 - DNA, 945 bp, Zea mays
  misc_feature (587)..(587): n is a, c, g, or t
  unsure (1)..(945): unsure at all n locations
tttgtgcagttggttgctgaggtactgaattcagagtagcatgctgtgcagtataaacaccctgatacaagaaaaggtgagacaataatacggaacatacacatactagttgagaccaaaaccaacattatctgctcagaaaacaacaaaagaactaatgtctactagcaaacaggaaacatataatcaataagactcgttcctgttaatactaaagcagaaatactgacagtgagaaataaataatttcaaagatgaaacatcagatctatggccttggggttattcacttactgacacattaacagaatcccttatgggatttagagattctaaacgtttcttcagctcctccaatcttgcatattgggaagcagcactctcctggacctagttaaacaaaagataaaagatcttaagcacatatggtgaaatgatggacatatattcataaaaggaaaattagaagcatactagatggtttaggtcatcacataatttctgcttagcatcctcttcgtctttaacaacttgtgcagcaacttcccaagtctagaataccagacacgtagtaaaaaatagcaganaacataacttattgttagcgacactagaataaaagagaaacacaagtatttacaaagaaaaaatagggaaacagtagaggtctgatcatctacacgagacattactccctccgtctgaaataagactatatacttctagcatttgaaaattgtcctacaaaataagtacacttttagatcatggaaaggcagcttcagtaagctttactactctctccatttccaaagtgtgcctccccaaagagctcggtggtcttggaatttgtgatctccaaaaccttggctaggcgcttcagttgagatggttgtgactgaagaaaacagatcctaatcaaacaaatttttatgtgccagtcca

SEQ ID NO: 102 - DNA, 747 bp, Zea mays
  misc_feature (110)..(110): n is a, c, g, or t
  misc_feature (118)..(118): n is a, c, g, or t
  misc_feature (168)..(168): n is a, c, g, or t
  misc_feature (196)..(196): n is a, c, g, or t
  misc_feature (351)..(351): n is a, c, g, or t
  misc_feature (445)..(445): n is a, c, g, or t
  misc_feature (527)..(527): n is a, c, g, or t
  unsure (1)..(747): unsure at all n locations
gctacctgatctgccacctggccaggacagcatgagtgcatgacacagcagcctcacaagccttgcatccaaggcagacactatggcagatgccgccgcagtggggtccnctcttgcngccttccttcggtgtcactccagcatcagcatgctcccctagaccctaangcaggtctccaagctcgataccacaccntccgcctcacactattatttgttagttttacaatattactatcttcttttggtttgtaccactctcatcaagttttgatctctaacctaccagaacttgaaagggactactttggtgatgtggtgtgatatagtgggcatcccaatcgaaatggnattctccaatagaggcctcaccccttcttttacactcgcagatatttttaccatgtcctagtctaatttttccatacaactgacaccaaaaaanattggaggtgaagtacttttctagaaaacaaacagaagcaagacagtgtaaacaaggtgatgccaacaaaccaacatcaaantctcatagatgccttacttttgttgatatgatctgaattttcttcatgaatgagaaagacaagctcccagtatcaccggttgacaactttgttattaaatggatgatacataggcaggcagctacctgttgaaatgaacaaataatagcaataaacatttcaaagtaccttgcaaatcttattagcatgattagtaaccacaagtccacaacactctact

SEQ ID NO: 103 - DNA, 526 bp, Zea mays
gatgttaccgtggtgattagatcccgtgtttgagtaccgcagcccagaagctcagttctgtgcggacacccttttcagtttccacttgggccttccattgtagcggtgggtgaataagagagtggaagtgctttgcaaagtcatcagatctcttttaggcccttgcgtttctcttccgttactggtatccatcgaaccaggtttctaaatcctgccgattgtgaacttgtgccgtgatacactagtactgcgggaataatgatcttgggatggcattgtcagcaccgtgctagtaaataaagatgcaatttgatttattcctttggcccagcgtcatgattttgttgtgtttcacatctgttggtactgcggcatgctactggttgaaactgtgtttgtgctgcaccatcctgtgcgcaaaataatacagcggccaataggccatgtcgccgcattggatgtgcattgcacttttgtttcaagcaagcaggttcgcaccatggttttaaatctcccgctgtacaat

SEQ ID NO: 104 - DNA, 737 bp, Zea mays
  misc_feature (554)..(588): n is a, c, g, or t
  misc_feature (621)..(625): n is a, c, g, or t
  misc_feature (635)..(646): n is a, c, g, or t
  misc_feature (655)..(657): n is a, c, g, or t
  misc_feature (659)..(673): n is a, c, g, or t
  misc_feature (681)..(691): n is a, c, g, or t
  misc_feature (694)..(694): n is a, c, g, or t
  misc_feature (699)..(719): n is a, c, g, or t
  misc_feature (722)..(735): n is a, c, g, or t
  unsure (1)..(737): unsure at all n locations
ccatcatctcctttgcacggatcagcttctcgatttgcctcacgatctgggaagaaaaattacacgagaatgtgcccagtgttaaaatcagttgtattcagaagttacaaggtgctgtgcctaattgtccaagataaagacatgtggtctgcaaagaaataaaatgtcactgacttacttcaaggaccatgtcctcaagcgtcaccaagtcaatgctactgtacccccgctgagaagccacatctgaaaggtgttgaggcatctcagaaaaagttcacccgattatattcaccatttactaaaggggtgtttgttcccctaactaaagtctgtgtcatattgaatgtttgaatgccaattacaagtattaaatatggtctaactataaaactaattccatagatgaagactaaacgacgagacaaattcattaagcctaatgactccatgattagcaaatgtttattgtagcatcacatggacgaataatagactaatcaggcctaattgactcatcttaccgtttagtccttatctttagtctttatctgtgnnnnnnnnnnnnnnnnnnnnnnnnnnnnnnnnnnnctaactagtattcaaacatttgatctaacgggnnnnnaatttagtcnnnnnnnnnnnnatgagcacnnncnnnnnnnnnnnnnnnatgagcannnnnnnnnnntcnacggnnnnnnnnnnnnnnnnnnnnntcnnnnnnnnnnnnnnac

SEQ ID NO: 105 - DNA, 352 bp, Zea mays
  misc_feature (206)..(208): n is a, c, g, or t
  misc_feature (216)..(222): n is a, c, g, or t
  misc_feature (262)..(262): n is a, c, g, or t
  unsure (1)..(352): unsure at all n locations
gctggctggcccagtcgctgctcgatttatcgtcgtcgtcgcggtgtatccgcgttagaaccttttgttggtgaacaatattatcgtggcacgcgttttaagtaatacggtattctggttcggtttcgtattgctgtttcttttctgctttatttctattcttgtcttgtttcgcgtgcttagccgtcttattaaccgaaggctgnnncaaaatannnnnnngaataaacaatgggtggggcaagaaattagtccgttaatnatttcgtaacgttcgttagagatgaagttggccagacgctcgacagcctggtttgggtgggacctactggggagaggtcggccgctctat

SEQ ID NO: 106 - DNA, 652 bp, Zea mays
  misc_feature (545)..(547): n is a, c, g, or t
  misc_feature (602)..(607): n is a, c, g, or t
  misc_feature (611)..(612): n is a, c, g, or t
  misc_feature (615)..(645): n is a, c, g, or t
  misc_feature (647)..(651): n is a, c, g, or t
  unsure (1)..(652): unsure at all n locations
ttgacatatataataattccttcaccgggccactcccagaccaggtggggaacctgtcaacatatctaattgaatttagagcaaatgcaaacaagctatccggtgagcttccgtcgtcattgtcaaacttaagcagccttgttagtatctattttcacgacaacctactcacaggagccataccagaatccatcacacgtttacaaaatctcatcctgtttgatgtcgccagcaaccaaatgtcaggtcgtctcccaacacaaattggcaagctcaagagcctacaacaattctacaccaatggaaacaaattctatggccccatacctgacagcatcggcaaccttacgtcgatagaatacatctacttgtccgataatcagttaaattcaacagtaccatctagcttgttccagcttcccaaacttatctatctggatctttctcataattccctcactggttcactaccggtcgacgttagtgggctaaaacaagtggattttgttgacttatcttccaattatttgtttggaagcatcccnnngtcatttggaacacttaagatgctcacttacctagatctatcattcaactcattnnnnnnctcnntcnnnnnnnnnnnnnnnnnnnnnnnnnnnnnnnannnnng

SEQ ID NO: 107 - DNA, 585 bp, Zea mays
  misc_feature (66)..(66): n is a, c, g, or t
  misc_feature (75)..(75): n is a, c, g, or t
  misc_feature (140)..(140): n is a, c, g, or t
  misc_feature (302)..(302): n is a, c, g, or t
  misc_feature (305)..(305): n is a, c, g, or t
  misc_feature (308)..(308): n is a, c, g, or t
  misc_feature (310)..(310): n is a, c, g, or t
  misc_feature (312)..(315): n is a, c, g, or t
  misc_feature (318)..(318): n is a, c, g, or t
  misc_feature (322)..(322): n is a, c, g, or t
  misc_feature (324)..(327): n is a, c, g, or t
  misc_feature (350)..(350): n is a, c, g, or t
  unsure (1)..(585): unsure at all n locations
atcaagatacctagtggaatgcagaggtgagaatggttaaaaaacaatgatgtgtaaagatgtganttttttttncttttcatctgacaagtgatcaccagaagctattgagaaaagtattggatacaagtcggctgccnctgttatatgcaccgccagattcgccaacccacggagcagaccatggtccatggcgctgtatggtgagctggagacctctgaatatatcagaagtccggctcagatactgcgggctcaaaatcctgtttggaacttggggatcatcacctaatcaggattgnagntangnannnntgngtcncnnnntggatgcaaagacataaaaacanaatttcctcaaggagtagagccagcattatgtccagaaagggctcaccagcaccaagattgtagatatgatgggtcactgcattgagaacgtttggcccggaggcctcgagaagctgagcaaaccacttttggtcatagaatcctcctggggctacaaccagtggtttgctggaatctccgtatagctcgttgacgatggtttgaagtacgactaggtcttttccatattgctca

SEQ ID NO: 108 - DNA, 354 bp, Zea mays
tctaggcgttgcgaaagcaaggggaggagtcagcaagacgacgcgccaagcgaatggccgtggccgtggccgtgctgttgcttcagtaaatagtgggcagatccacggctctcctttggaaccaagctgctgctaccaggcttcgttgctcgatctctcgacggcagtgctatcaaatgctcggttagcggggcgcgtggagatccgcgagaagatttcttccaatctccacagcagataagggagcggctagtttccaccacgtttttttttggcgaacagtatagtggactgatcgagtttaggatgagaggcagagtgtggtttgactgtgtaaggctgggtagtgtgtac

SEQ ID NO: 109 - DNA, 591 bp, Zea mays
  misc_feature (1)..(173): n is a, c, g, or t
  misc_feature (175)..(175): n is a, c, g, or t
  misc_feature (182)..(182): n is a, c, g, or t
  misc_feature (203)..(390): n is a, c, g, or t
  misc_feature (397)..(397): n is a, c, g, or t
  misc_feature (399)..(399): n is a, c, g, or t
  misc_feature (459)..(459): n is a, c, g, or t
  misc_feature (468)..(468): n is a, c, g, or t
  misc_feature (478)..(478): n is a, c, g, or t
  misc_feature (486)..(486): n is a, c, g, or t
  misc_feature (509)..(509): n is a, c, g, or t
  misc_feature (523)..(523): n is a, c, g, or t
  misc_feature (525)..(525): n is a, c, g, or t
  unsure (1)..(591): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncngcaacanttgctaccattctacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattananatctatattttaagttcaaatgcacccaagtgtgttccaccattttttgtttcgctaagnccaaatacnaaaacctttnaatcatanttattgtatgaactctgcataantccacactaccacntncaaacattatgaaggggttggtggctagatggaggttgcaacctagaggatgagaaggatgatgtg

SEQ ID NO: 110 - DNA, 572 bp, Zea mays
tatccgtaacggagaaaaaaggttggtgttttcttggtggagcagagctgccgatggatgcagatgtctagtgtactgtactgtacacccttatggttgaggagtccatcagtaattcggtttcgatgaaggcctaggcctagcctcctcgttcttcaggagcatcgaggagtccaccagcgtcctggaatattcggcaccgcttgaatgagaagttagctcatagtccatctcgaactaggcagagtattattgtagcgaacctagcaggcaaaaaaaaaaaacagaggatatcctaagttagaaaggatggatgaatccctggcatggatgattgcagcctctcaaaatattagccaaaagaaaagagagtgtaaaaacgatgtgggcttgtacaattggtataaacttgaatgggcaaatttgtgttatcatgtgtgtgtgttgatgtgttcccttcaattcatctacatttgcgaacaaagcttggcagtagtttagctactgaatctagctgcacaggagcatgatgtccagggcaccaaagggatacacgctgctgcaggcacgca

SEQ ID NO: 111 - DNA, 699 bp, Zea mays
  misc_feature (627)..(628): n is a, c, g, or t
  misc_feature (630)..(634): n is a, c, g, or t
  misc_feature (645)..(651): n is a, c, g, or t
  misc_feature (654)..(669): n is a, c, g, or t
  misc_feature (676)..(680): n is a, c, g, or t
  misc_feature (685)..(685): n is a, c, g, or t
  misc_feature (689)..(689): n is a, c, g, or t
  misc_feature (692)..(697): n is a, c, g, or t
  unsure (1)..(699): unsure at all n locations
aaacgggtgtaatgcatcgggaatggtgaggattgttccggtgtttccacagtatctcagtgactcggttgatggctttgatgcattcgatgggtttgaagatgatccaggcgttgacaaagatgaaaagccctcttctaatgctcaaaatgggtcgcagctgccggcattttcaggtgtctacacgtctgctcaggttagagagacttttgagagtgatcctggtcgggacagcagctcggacagggatggggcaagcaccatctttgaagaaacggagagtgtctctatgggtgagatcatgaggagtccagcattcagtgaggactgttcatcagagaactctttctgggtagatgttggccatagcccattggggtcagagaagtctggtcagttcaagaaagggaaactgggttcaccattaccatcttcttggtttaatggaagaaagtgtaacaagaggatgtccccaaacttaacttccaggatatctagaagtccactttatgatggtcatgtgatttcctttgatgcagccgtgctatcagtctcgcaagatgcagactgcctcaaggaagaccctgaagaagaaaattttgagaatgggcggagagctcatttcanncnnnnnagtgaaattcnnnnnnngcnnnnnnnnnnnnnnnnggcatgnnnnngtgcnatgnatnnnnnngc

SEQ ID NO: 112 - DNA, 1271 bp, Zea mays
  misc_feature (410)..(430): n is a, c, g, or t
  misc_feature (511)..(511): n is a, c, g, or t
  misc_feature (619)..(623): n is a, c, g, or t
  misc_feature (721)..(721): n is a, c, g, or t
  unsure (1)..(1271): unsure at all n locations
ccaattttgtttgttactatctgcaatttagaacaactatcaaatacgatgattttgtggccgaactttttgttctgccatcttgccatccaatggaaatagatgctaacagcactaaatcaaggcaccttagctgtaaagtcaagtactgctgaaacatgtattttagaaggaatgtaaaagatatttagcaaagaaaaacatttgtcatagaactaaaattccagttgctcactacggttgagtaaagaggtcacgagaaaaatacctaagcttatcgactggagtgcagcccagatcaattttacatactggacagtggtccagatcctcatcattgatcttattatagatacaatttctacaaactgcataatacaaagatcacaagaaaaatagaggtgagaacnnnnnnnnnnnnnnnnnnnnnggtacagcacaatgcttcatttcaagtagaatagaaatttgctgtctaaacagaagttcttttcagaaggacaggcatggnacagtggtgagaaaccttccaaccgagctaaaaggtcatgggtttgacgcaaactctctgcaaaatgcaggggtaacgcttgcctcagttattcctccccaagacccnnnnngctgctagcattgagtctgtcctttaaacaaaagttcttttcaattgaaaacataatagatccatgtcatgacaagtaaaatgatacatgtaaaagancaagacatgtcgatatttgtactagcgtggaccatacagcatgagattcatatggatcctactatttcaaaagcacacacaacatgaacagttacaccaattcactcacacatgcagagtaaccaagtaaattgcaactatttacagtctatgatggtacattgtggcttcaaaagctgtgtacagttccactgattacaggaaaacattcgtcgaacgcccactgaataccaagagggggtgttaatcctgaactcaaactggatagcaactcaaatcacagcaccggaggcttaataacgttctcctgaacattatctcaacaggaaccaaagcatttcacggattgggggcaaagatgggcaatcaacagcacgggaatcaaagtgcacgtaaaatgcacatgctgaagcccagcattgatgcaacattgcatcacgattcaataaagagaattgcagctcagcctggaaaggcaagaatagaaagcaaggaagctaccgtggtcaactcgaactagatttacgtggagtccagagtggaggtgcga

SEQ ID NO: 113 - DNA, 1010 bp, Zea mays
tacccctgtatcttattatcatcctttacatgagaaattgccttctcaatggcagtgatttccttctggatatttgacaagatctgttttggctcattcgggttgttctcatcaagcatttctttggttttcttgatatcggtagcaatcttctgaaccctcccttccagcgcggctagtttctcatgtagtttgcttgggtacctgttcatagcagacacgggttttgctgaccctccctccccacctgcagccactttctcaaaaactcctatcctgtctgccaattttaccttttcttcctgcttcctgccctcttcattattcttttgctgtttccttattggatcagggacatcatttgaattcaccacatggacagtgaaaacagggatgacagaagtgttgcctatatcgtcatccttctgggtggcacaacattccacagatttggaagcagactctcctggatcagcctttttggtattcatctccttcatcaatttattgggcccctctttcttcatattgatttcttcagctgcggggtaacagcggtcatttggagtcagcgccgaaatcggtctgggatgacgtcatagacgctgattgggaagctgtagaactcctcgtttctggggtccgagtatcccttatggcggcgcaggaacggctggaaccacgagagcccccggtcggcctcgtagcccctgaactccagcgtgttgtccaggacagaagcgacaattagcgccaccgtcggcccggaagcaaacacggtgtttataatgtcgttgaactgcacaaagacatgtttagatgtcaaagttctggatgcgaccagacataactgcagcatcaagttacagaccgacagcgtatttgatgtggcatgcagaaaatttaacacatgcagttggtagatgggtgatgcaagcactgaatgtaacagatttaaagggagaatcctcaaatacccatccagcatttgtccgggcaggtccgtggcc

SEQ ID NO: 114 - DNA, 719 bp, Zea mays
  misc_feature (118)..(118): n is a, c, g, or t
  misc_feature (246)..(246): n is a, c, g, or t
  misc_feature (281)..(281): n is a, c, g, or t
  misc_feature (435)..(435): n is a, c, g, or t
  misc_feature (438)..(440): n is a, c, g, or t
  misc_feature (443)..(443): n is a, c, g, or t
  misc_feature (445)..(445): n is a, c, g, or t
  misc_feature (457)..(457): n is a, c, g, or t
  misc_feature (502)..(502): n is a, c, g, or t
  misc_feature (710)..(716): n is a, c, g, or t
  unsure (1)..(719): unsure at all n locations
accattgcagtcctctttgtttgttcaaattagattttaaactccacacctcatggaatttgagtatttcagggctttcatgattgaaaatgtaccccaaattagcttataccccgantcgtatggccctcttctgactggtgaagaagaagtaattggaggtgctggaactcgcaacgcgtttccttgccccatttctcttatttgtcggtaactactaatttctattgtgctgacaaggaggcntatcaagcattgacaataattcctctgttgcgaantttttttggatggaggctatgcttgaaaacatgttggcatgttgcctttatacagtgacaacattgacttcgctgttaagttttcttagctttcaaaatgcatagaaagaatctctcattttcttttgatcagaagaatctctcattttccatntcnnnatntnaggtgcatcacntcatcttagccttggatgtcatagatgattagtgtgaatggttgnccatctgctagtttctgggttccctaagacaacatatgctcaacatctcgcaggaagaaagagagatggcacacctctacgagcgcaggaagttcccgtaccctggcgatgatgaggcggtcgaggagtttgtaaagagcggaggtgctcttggaaccacaattggacccaggggattcgctgacgccaatatggattctgaaaacannnnnnngca

SEQ ID NO: 115 - DNA, 778 bp, Zea mays
  misc_feature (65)..(74): n is a, c, g, or t
  misc_feature (168)..(169): n is a, c, g, or t
  misc_feature (211)..(211): n is a, c, g, or t
  misc_feature (217)..(217): n is a, c, g, or t
  misc_feature (220)..(226): n is a, c, g, or t
  misc_feature (296)..(296): n is a, c, g, or t
  misc_feature (363)..(364): n is a, c, g, or t
  misc_feature (430)..(430): n is a, c, g, or t
  misc_feature (433)..(433): n is a, c, g, or t
  misc_feature (528)..(528): n is a, c, g, or t
  misc_feature (532)..(539): n is a, c, g, or t
  misc_feature (610)..(610): n is a, c, g, or t
  misc_feature (635)..(636): n is a, c, g, or t
  misc_feature (657)..(658): n is a, c, g, or t
  misc_feature (666)..(668): n is a, c, g, or t
  misc_feature (674)..(674): n is a, c, g, or t
  misc_feature (682)..(682): n is a, c, g, or t
  misc_feature (696)..(698): n is a, c, g, or t
  misc_feature (705)..(705): n is a, c, g, or t
  misc_feature (721)..(726): n is a, c, g, or t
  misc_feature (730)..(732): n is a, c, g, or t
  misc_feature (734)..(735): n is a, c, g, or t
  misc_feature (739)..(744): n is a, c, g, or t
  misc_feature (747)..(752): n is a, c, g, or t
  misc_feature (754)..(754): n is a, c, g, or t
  misc_feature (757)..(760): n is a, c, g, or t
  misc_feature (762)..(777): n is a, c, g, or t
  unsure (1)..(778): unsure at all n locations
cccctgaaacattgagctattaaaaattagaaaacgacacaccttcagatactttctgattctannnnnnnnnntgaaacctcttggtccttacttgcaagtaaaagctacatattatacaagtaatttgatgacaatgagctatgcagtcagcatggaaatgtcaanncctatctgtgagaaaatatcaggagacctagcattaggattnttttgnttnnnnnnnctactgattgaattcatgcatgacttacctagtgcaatctagatgaaaaggtctaacattttccccatcntaattaagcctgctacaattcacaactggggagatagaaactcaaactatggcagaggcataagtgnntattagagtcaatccatctacaatgaaaagtatgctatattcataggtattggcatttcaattaancanacaaacagtagttactgcacgataaaacaactgaacatcaactttctagcattttgctgagataggacccccgcagggtacatattacaagacangatnnnnnnnntggagtagcatagcattattctagcataattatattaacataacatgattaggtcaggtcatactcatccngaagttgtgtttcgtcaccatagtnnctttggcagcaaaacaaactnnacagaacnnngtagtnaaaaagangcacagatcgcagnnngcagttnacatattttactactnnnnnntagnnngnnccannnnnnatnnnnnncntannnntnnnnnnnnnnnnnnnna

SEQ ID NO: 116 - DNA, 661 bp, Zea mays
  misc_feature (379)..(381): n is a, c, g, or t
  misc_feature (411)..(412): n is a, c, g, or t
  misc_feature (455)..(455): n is a, c, g, or t
  misc_feature (489)..(490): n is a, c, g, or t
  misc_feature (508)..(508): n is a, c, g, or t
  misc_feature (512)..(513): n is a, c, g, or t
  misc_feature (516)..(522): n is a, c, g, or t
  misc_feature (539)..(548): n is a, c, g, or t
  misc_feature (554)..(556): n is a, c, g, or t
  misc_feature (560)..(562): n is a, c, g, or t
  misc_feature (571)..(572): n is a, c, g, or t
  misc_feature (580)..(581): n is a, c, g, or t
  misc_feature (583)..(588): n is a, c, g, or t
  misc_feature (600)..(600): n is a, c, g, or t
  misc_feature (602)..(610): n is a, c, g, or t
  misc_feature (617)..(618): n is a, c, g, or t
  misc_feature (620)..(626): n is a, c, g, or t
  misc_feature (636)..(657): n is a, c, g, or t
  misc_feature (659)..(659): n is a, c, g, or t
  unsure (1)..(661): unsure at all n locations
gcaatcagtgctactttagctgctgtaaaggctaggcaagttaacggtgagatggagcattcacctgacagggaacaatctccagatgctgcaccaagtgccaagcaaaattcaagccttataaaaccagatcctgctcttatgaacaattcaacaccaccacctggggttcggttgcaccatagagcagtgagttgaaaaaatagttcattttgctgcttgttgtttaaatttagttattctattcttatttagacattcagtctgtttaacttagaagtcatcacatttacatgaaaaatgctcttatttgttttgatgccagttacatattttggccttgtaggttgtggtagcagcagaaactggaggtgccttnnntggcatggttagacagctctcgattgaccnntttgagaatgaaggtagaagggtcatttatggcacccctgagnatgcaactgcggcaaggaaattgctggatcgacnnatgtctattaatagcgtncccnnaannnnnnnctacatttttctactannnnnnnnnnactgannnaagnnncacatgctnnaaaactgnnannnnnnttatcataatgncnnnnnnnnnaaaaacnngnnnnnnntatgatgacnnnnnnnnnnnnnnnnnnnnnncnat

SEQ ID NO: 117 - DNA, 594 bp, Zea mays
  misc_feature (104)..(104): n is a, c, g, or t
  misc_feature (277)..(277): n is a, c, g, or t
  misc_feature (281)..(281): n is a, c, g, or t
  misc_feature (315)..(315): n is a, c, g, or t
  misc_feature (355)..(355): n is a, c, g, or t
  misc_feature (422)..(422): n is a, c, g, or t
  misc_feature (519)..(519): n is a, c, g, or t
  unsure (1)..(594): unsure at all n locations
tgtgcttttgactggaacttgtgtcgtcttatggacatcagagaagaatgatggtagcaggccatctcgtgccatggccatcaatattcttggctgaaggaagnatcaaagtggaagtatgaataccaatagcagcataaactgaagttgtgcaatgcatatgcttgttgcgagaacagataaagcagaaaactgatgatatatatccagattatatgccagtattcttcagatgttactcattttaaaaccatgcccacttggctgatgactcatntttnccatcaatttgaatcacagaagaaatttgatganacattggttaagatatgcttatacctgtggcaatatagancccatcaaggttgagcagagagcaagaacagcaccagttgttacaagatacctaaaacaagataagnacatgaaaacaatctcagtcagacgcacaccagatcatccatgaaaaaaatgagaagaagtccttacattgcccagtgcatcccatgtttggcaaangcagatgaaataggggtgtctgggtccatagcaaagtatggtaccagaccaacaataacaactgaaaccaacatg

SEQ ID NO: 118 - DNA, 973 bp, Zea mays
  misc_feature (2)..(7): n is a, c, g, or t
  misc_feature (14)..(17): n is a, c, g, or t
  misc_feature (41)..(44): n is a, c, g, or t
  misc_feature (73)..(75): n is a, c, g, or t
  misc_feature (117)..(117): n is a, c, g, or t
  misc_feature (172)..(174): n is a, c, g, or t
  misc_feature (402)..(406): n is a, c, g, or t
  misc_feature (640)..(640): n is a, c, g, or t
  unsure (1)..(973): unsure at all n locations
annnnnnccagtannnngggctggggagctgaacccaaaannnntgtttccagagctcggaaatgtaaatgannnggttgaagcagactgtaaacctggtgcagtggaagtactagntggtgcagccacagatattccagcagcatcacttgaaggtgcaactgcggtgaannnaggcgtagatgtggcgggggaacttgaaaagcttgcaatacttgatgacacaggtgaaataaaaagttccgatgatgccttgctgcttgcatctggtgcaacagatttcacttcagcttttgtaccccctataccaaatgataaggtgctagtgccatcagatttagctgatgttaccaatgacaatccaaccggagcactggaagaaaaactaaatcccgtaaatgnnnnngacgatgaaatagctggactgctactggatacggcaaatatggaagtggaaacaggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagtatgttatttatgtngctagctcacccttttctcagccattgctcctcctagacccttttgtgatgacatcatacttgctgttcttttgaatgcaggaccctaacatctctgagcagtgtgactgcctatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaagggtaatcatgcttgcacttattgtctgccataaaattggatttagttaca

SEQ ID NO: 119 - DNA, 371 bp, Zea mays
acaaattcatctttaaattggccctacatatgatataactcacactgagtaactgttgatatcatattctaaatgactaaaagatttcagttattagcatattatgatatcacacacctttccaacaacctcaaacgtccattgtttcaaccggaaggccactgcgtttagatgattatttggcatggaggcccagtgtgtatcaccatttaaactctgaaaaggttagactttccctgatgaaaccttctaattaagtgggtaagcaaagcactattcagtaattgtatcacctcctgttctagcaggaatctccaaaatctcttcaccaggccaaactccgtggggaacgtgttactcactttgtgctt

SEQ ID NO: 120 - DNA, 1081 bp, Zea mays
  misc_feature (1)..(1): n is a, c, g, or t
  misc_feature (5)..(5): n is a, c, g, or t
  misc_feature (7)..(9): n is a, c, g, or t
  misc_feature (12)..(14): n is a, c, g, or t
  misc_feature (515)..(516): n is a, c, g, or t
  misc_feature (618)..(618): n is a, c, g, or t
  misc_feature (633)..(634): n is a, c, g, or t
  misc_feature (668)..(668): n is a, c, g, or t
  misc_feature (708)..(708): n is a, c, g, or t
  misc_feature (864)..(864): n is a, c, g, or t
  misc_feature (936)..(936): n is a, c, g, or t
  misc_feature (1027)..(1032): n is a, c, g, or t
  misc_feature (1035)..(1046): n is a, c, g, or t
  misc_feature (1048)..(1060): n is a, c, g, or t
  misc_feature (1062)..(1062): n is a, c, g, or t
  misc_feature (1073)..(1076): n is a, c, g, or t
  unsure (1)..(1081): unsure at all n locations
nacgncnnngcnnnacaagcccggtgtctccgaccaccgagcaagggtcgctcccgttctcccgcgtcccagcgcaccagcccccgggagtcggcacgtccgcgccgcggcccaggatctcctcgtctatcctgtccagcaccgggtcgtcctcgtggaacttgcgggcgaacggcgcgtcgctggcgaccatgcggtccaggtcctccgccgtcaagtagtgcgggtgctgcttcggagggttgtcccacgagatgtagtgcaggtcgtggttcaccgtcgtgttcttgaactcctccgcgttgcacacaacggtgtggaagtatccttccggcgacgagatgaagtttgagtagtacatgagcactgtgcgaggtaggttgtcccagccccatatgcagtattccacaaagggcctggacagtgccatccaggcagaacctgcgatgtcataggctcatcaggtgcttctatatctgaatcagtaactgacatatatagatgcctggttatcnntatgagctgtctggacctagagtagtgtttatatctaagctgtagtgtctgtttaagaaattggaatcaattaatttcctgcctacacagagaagtgcaaanctcctttgggggganntggctaagcatggataatggatgtagaacctgancaccatatttatattaatgaaaaaacctgatttttgtggnaaaagttcattgacacggtttcattaatatataaattagtaactgacacataaaacaaggatagcctttcaaaaattaatggcagctaacataaatgcatcaggggagtaatcgagccaggaatgccttggttggtttccagaacaggaggtcatntttacatgcaaataaatgtgttgccatacaaatgttctctactacaggcaacaaacaaatagaatcacaaangtttgttccagcaataagatcaaacaaaataagattatacagatggaaaggtaattttttttaccaaggagaatttcaggcagcgatatannnnnntgnnnnnnnnnnnnannnnnnnnnnnnncncagctgtatgnnnnatttt

SEQ ID NO: 121 - DNA, 208 bp, Zea mays
catatgctgctttggctgaatattttccattagccgccaatctgaagatatgcttatcttcttggtctggatgtaaagaaactgcctccagaacatcccagaggtccaggaagtcagcaagaacccccactgtcaaggcgcccctaatatccatcgaccattttctgtctgttagagcctattggactgttttgcaactcttgattcc

SEQ ID NO: 122 - DNA, 658 bp, Zea mays
  misc_feature (90)..(90): n is a, c, g, or t
  misc_feature (133)..(134): n is a, c, g, or t
  misc_feature (140)..(140): n is a, c, g, or t
  misc_feature (171)..(171): n is a, c, g, or t
  misc_feature (179)..(179): n is a, c, g, or t
  misc_feature (184)..(184): n is a, c, g, or t
  misc_feature (594)..(596): n is a, c, g, or t
  misc_feature (606)..(606): n is a, c, g, or t
  misc_feature (608)..(614): n is a, c, g, or t
  misc_feature (622)..(628): n is a, c, g, or t
  misc_feature (630)..(645): n is a, c, g, or t
  misc_feature (647)..(650): n is a, c, g, or t
  misc_feature (652)..(652): n is a, c, g, or t
  unsure (1)..(658): unsure at all n locations
atcactacgcaaccagaagcaggatgcgctgtgcacgaactacacttcatggaccaatattacttacaaagttacaagtcgatgaaaagnaccacctgggagaaaagaggttatagcttttgaatcacatcannttgtcntcaaagaaatccgataaaaaaaacatggtcnccataacngtaantggtcaatagttgcaactaactcatgtttgaagcaactgacctagcctttctactcctaaaaacatatatctagcatagaattttctcaacgacagcctgtagactgcctagaacaaagagcatcataagaaaacatgaagcttcaggcatagcaaatacttatcatacaataatcagcagagattaatgcaacatacacattcccgaagctgttcttcgcatatgaaccaccatggtgaccaacatacatgaagagggaaccagaatgcttgagtctaacatgagggaagtgatcatcataatcactgattacctcacacaaataaacacccattttttattttaaagaaaaaccaatatgtgatacataccccaaagtttgcaagcacatgggaatgggacaccatcnnnatcattctgntnnnnnnntgtcatcnnnnnnntnnnnnnnnnnnnnnnntnnnncntttttt

SEQ ID NO: 123 - DNA, 835 bp, Zea mays
gcatgcctgcagatgtggaaatggtaaggatttggaaaaaatagctttagcaaatgaatgatgcatcataatatgcaaggataatgaaaaacaagaacaaataagtataccttacgcaatctcttatacttaatgtcatttggatgctctataacattcttgataatcttaaagagagtttgaatagcagactctgcctctacaggtgttgcttgcaaccgaagcatcttaatggacttctggagtcgtgaacagagggctctcactggttcttcaaccctttgcagctcattgatgtttgagtcaccaacatgatcgtcaggatcaggttcagctttcagaaccatggaatttccactctgttctgttatcatttctgtcccattaccagattttaaaacatcttgacaagtatcatcaggatcaggttcttcaccatgcttcccatcaatgatcaactcctggttagcatttgaggaatcagcagggtcaagttcatacttcacaactgtgatgtggtttgtcagttcactatccatttccatcgtgtttccatgttccagaacttcattactaccatcatcagggtcaggttcactaaggtgtcttacatcaaacctcagctcctggttcagattattagcatttgaggaatcatcaggatcaggttctaggcatctatcaaaactttgcttgccaacatcgtcaggattaggatcagagtaaccaatagtatgctgccctgcaaatgatagccccagctgctgaatccacatgcatagcataaatcttggatctgggctcttcccttcacaggtttcatggaaccaaaaac

SEQ ID NO: 124 - DNA, 918 bp, Zea mays
  misc_feature (30)..(31): n is a, c, g, or t
  misc_feature (33)..(33): n is a, c, g, or t
  misc_feature (481)..(481): n is a, c, g, or t
  misc_feature (484)..(484): n is a, c, g, or t
  misc_feature (590)..(590): n is a, c, g, or t
  misc_feature (696)..(696): n is a, c, g, or t
  misc_feature (710)..(710): n is a, c, g, or t
  misc_feature (725)..(725): n is a, c, g, or t
  unsure (1)..(918): unsure at all n locations
gcatgcctgcagcagtacgcggccgcgccnnantctgtcccgccagtgccaacccacacagtggtctactggatgtttggcaactcgtcctgtgcagaagctcggagctccaatgcctctggctgcctcagtgacgagagtgagtgccacgatgagcctccgcgagggtatagatgccagtgtggccaaggctatgttgggaacccctacatgccgaacggttgccaaggtacgcatcttccggttcaggttcaacttgtaccatgtgattactttgcactaattagtaataacttgtttttactcatggtaatagatgttaatgagtgcacacagacagatccaccgccatgctttgggcaatgcataaatacaataggatcatatgattgcatctgcccatctggcacctcgggcaaccccagagtaaaagatgggtgtagtccaagcaaattgaaattatcaggtaacaataaaaaantcntgatatctcttgtttatattctaaggaactaagcctagcttagtttgccatgagggtggatgtacaccaatatcgcccaaactcaagttctcatcgagacgaattngggtgcctatttcttcttaattaagtcacctagttcctcctacattggtcgattattttaccaacactcttgtagtgtagcgatgaactttcctttcttatttttnattaatataatgangggtacatctcctancgtttccataaaagaaaaggttcgtcgaagtaaataatctgaattccattttttcacaaattacccaggattgatcattgcaatcggacttggaagtggtattgccattctgctgtttgttttcgccattgtcgtcataaggagaaaggtcaaggctcggaaagctagaataacgaaagagtttttcttcaag

SEQ ID NO: 125 - DNA, 357 bp, Zea mays
  misc_feature (14)..(16): n is a, c, g, or t
  misc_feature (18)..(20): n is a, c, g, or t
  misc_feature (39)..(39): n is a, c, g, or t
  misc_feature (55)..(55): n is a, c, g, or t
  misc_feature (99)..(100): n is a, c, g, or t
  misc_feature (153)..(153): n is a, c, g, or t
  misc_feature (266)..(266): n is a, c, g, or t
  misc_feature (338)..(338): n is a, c, g, or t
  misc_feature (352)..(356): n is a, c, g, or t
  unsure (1)..(357): unsure at all n locations
agccttcaattttnnnannngtgcccattaactgcagtntgctggaaattctctntctggtatattgccttccaccgctcaagctcttccctgcagatnngtaacagcccaaacattagcatcaacttttttttgtttattgtaaagtaatangaagcacaagggttctcctgtgtcagtcaatcggttacacctttgctcttgcacagttagtcaaatgctgaaaggctcttaagaaaaatctggttatttgttagtattctagngctagaaacgtcggtcctataaaacagaatcctggtttcacaatttatgtgaggtatctggagatcaaaacngtttgctcctgtcnnnnnt

SEQ ID NO: 126 - DNA, 425 bp, Zea mays
  misc_feature (86)..(86): n is a, c, g, or t
  misc_feature (199)..(199): n is a, c, g, or t
  misc_feature (252)..(253): n is a, c, g, or t
  unsure (1)..(425): unsure at all n locations
gacaggagcaaacggttttgatctccagatacctcacagaaattgtgaaaccaggattctgttttataggaccgacgtttctagcnctagaatactaacaaataaccagatttttcttaagagcctttcagcatttgactaactgtgcaagagcaaaggtgtaaccgattgactgacacaggagaacccttgtgcttcntattactttacaataaacaaaaaaaagttgatgctaatgtttgggctgttacnnatctgcagggaagagcttgagcggtggaaggcaatataccagagagagaatttccagcagactgcagttaatgggcactgaatatgcaaaattgaaggcttgtttacctcgtagcgaagaagataagatacgaaatatataaagtgacattccgataaaactagggttaact

SEQ ID NO: 127 - DNA, 480 bp, Zea mays
  misc_feature (84)..(84): n is a, c, g, or t
  misc_feature (153)..(153): n is a, c, g, or t
  misc_feature (158)..(158): n is a, c, g, or t
  misc_feature (178)..(186): n is a, c, g, or t
  misc_feature (210)..(210): n is a, c, g, or t
  misc_feature (291)..(291): n is a, c, g, or t
  misc_feature (334)..(334): n is a, c, g, or t
  misc_feature (370)..(370): n is a, c, g, or t
  misc_feature (439)..(439): n is a, c, g, or t
  unsure (1)..(480): unsure at all n locations
aactctatgatgtgaattccaaacaggacctaactctgtgatgtgaaattgaaatcaaagtgccgactgccaatggacaggacnggtaaagagttttattgggatcccatctattttaggtagttgatcaaggttaagctgcactttggtganccaancagccctactaaatttggtnnnnnnnnnggtagttaatgaatggcaagatcnttgaactcaaaagcttatctcagacatgacaactcaaaagcttaccttgaacacgagtaccaatcagaatcggtacaaganggttacctagagagaactataaaacgactaaattaccacatanatagggaaacgcaccaccgaactgcactctactcanggtaaagacagtagcagcatcatggaaaggttgccaaacatgcatcaggagccactcgcgaaccaaaanccttttccccactccatgacacaaatcaagaaacggtaaca

SEQ ID NO: 128 - DNA, 450 bp, Zea mays
aagctgtcggcggtgattcgaggaggaaggcgccgcacgcgcgcagtggtccaccctcctgcttcactttccctccctccctccctccttagcgcgcacggcacgaggcggtccgcggtcgaggcaggcggagggaacggcggcgtgggagcgacggcacggggacgagatggagacagggacgggcggcgtggctcccgtgtgctcgataaatagcagcgcgcgccccgccgctagctctccgctcgtcgaccgggaagagagagagaaagagagagagagagagagagaggtgtgggggccggaaaggcgacgcgatgtgcccgcgctgacggatttgcccctcggcgctccctcgccgtagagaagctctggtctccgctgcgtggagtggagagaactcacatgtcaagctgttggctggagaaatgattgggcctgtggaaatta

SEQ ID NO: 129 - DNA, 628 bp, Zea mays
  misc_feature (216)..(218): n is a, c, g, or t
  misc_feature (611)..(611): n is a, c, g, or t
  unsure (1)..(628): unsure at all n locations
tccacctccacccgctcgatccctgcatacgcatgcgtgcgtgcgcattgagccatccacgccaggatcaggtgaaaaaaacaacaacaacaccaccgacaacaacaaaggcccagccgcccaggctttgggtaaagaagaaggagctagaattaaaggacgttcagaatccagatccagcagctctctacacagggagggacgatggcagcagcnnntgctgctgctgcataccgatcgtactggaagtaatgatcgatctgccggccgggggggccctggcagctggttggccggccggccggaatggacggcggcgggatggggtgggctttgttgaagcctgaaggcgctcatcacggacgtaacgtacgtacctttcactttggacaggcatctgcgtacccgcttctcatgcaacgccaccatctccactttcagctccgtgctctgcgaaacgccaccagcgatcaggaaacgcgcacaggattgggttgttcgttgtcgcaacaatgctgcctttcatgcatctgcatgtgcagtgcagtcccagctagctagtagcttgcgttgcttgcttgctcgcgagagctagttcatcatgcaaaggnaaaaggcagcactgcag

SEQ ID NO: 130 - DNA, 447 bp, Zea mays
  misc_feature (137)..(137): n is a, c, g, or t
  misc_feature (229)..(250): n is a, c, g, or t
  unsure (1)..(447): unsure at all n locations
ttcctttgggtttgtggactactatgatcgaagatctgctgctctagcaatcatgacccttcatggccgtcacgtgtaagttcagctgttataatactttgaacaacatgaatttaagagattaaattctggtgttntttattatcaaaattcttaaacagatatggacaagcaatcaaggtgaactgggcatatgcaagtacgcagagggaggatacgtcaggtgagnnnnnnnnnnnnnnnnnnnnnncttgttgtctctttcttttcatattataatccttgtttggttaaccgtgccaattgaattatttccagggcatttccatatttttgttggtgatttaagttctgaagtgaatgatgcaactctttatgcctgtttctcagcatatccttcttgttcgtaagtactttttgtatcatgatggcatctatgacgagctt

SEQ ID NO: 131 - DNA, 383 bp, Zea mays
  misc_feature (8)..(8): n is a, c, g, or t
  misc_feature (41)..(41): n is a, c, g, or t
  misc_feature (55)..(61): n is a, c, g, or t
  misc_feature (205)..(211): n is a, c, g, or t
  unsure (1)..(383): unsure at all n locations
atgtttcngtaaaaaaccaatgaggaccctcaagagcctantaagcatgatagtnnnnnnnccagattccttttttgtcgttaaattctttactaacatgagcatgttgtattatctccctccaggacaaggcaacaggctgttggaatatggaccaacaaggcatgcatgaccatgtaaggagttacataaccttgcatatatnnnnnnnatgtacagtgggtaccaaaatttctgtggctaacttatggttgctaaccatgacccaggaaggggtccacgttgttggatttgaagtcccgccttcaccggattccagctacgacaaccctgttcctgggaatgaagacgaaggccgggagcccccactgatgccacctcat

SEQ ID NO: 132 - DNA, 892 bp, Zea mays
  misc_feature (23)..(24): n is a, c, g, or t
  misc_feature (26)..(43): n is a, c, g, or t
  misc_feature (159)..(160): n is a, c, g, or t
  misc_feature (306)..(306): n is a, c, g, or t
  misc_feature (368)..(368): n is a, c, g, or t
  misc_feature (384)..(384): n is a, c, g, or t
  misc_feature (566)..(566): n is a, c, g, or t
  unsure (1)..(892): unsure at all n locations
tctatttgatacttaatcctttnntnnnnnnnnnnnnnnnnnntgatgcttaactcacatgatagttatatatttattgtctgtgatgttgagctctcgtttgccatgtatagctcagtatagatttttttagtggctagacaagcagtattttttttnngcgtacaaaccgattggggaattagggcctgatcttagttatatgcgtctgtctttggcttgttttcccaactaaaatggaatttcatatgaaatgcctatgtattgtgtgccagatttatatttgggttataaaaaagctaaaanataaaacagttaaaaattcccttctttatttgctaataattgtgaaagttgttcggaattcnatggtgaacaattctnattccttgatgccaatttcaggtagcagcatctatgcgaaaggatgcagatgccaaaattccgagctatccaaatctctcatctaagcttatatgcatactccgtagtgtcactatgcttgtaagaaatgcttccttcaatacagtatgaaaaataactgctgttgagctagttctcttttntgcaaacgattttgattaatgtatctatcaacaaaaattgacaggctgatcctgacacagatgaggtttacgctcgaatgactctccagcccgttagcaatgtaggtcacacttccctatcatcaattatatcagctgtattataggatgtacctgtaccaccttgaatttggaattggtactgttaggtgacgcattgtgacaaggagacgttgctggcaacagagcttgcactgaaacaaaccagaccacagacagagttcttttgtaaaacactgactgcaagtgatacaagcactcatggaggtttctctgtgccacggcgt

SEQ ID NO: 133 - DNA, 695 bp, Zea mays
  misc_feature (284)..(284): n is a, c, g, or t
  misc_feature (694)..(694): n is a, c, g, or t
  unsure (1)..(695): unsure at all n locations
gaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatggtcctcatatattttccgtgaatctctcttcctaccctaaatattgtgtgatactatttcgatgcctagctagcaggcttgggaagatgcatgaacatccaaatagtttttatcatatagaaatgatcttcaaactaaaagntgttttcttttaactagattaattttaccctatgctcgtttgatcgtcctaccaacgtacacgatcatcaaaatgacaccttgtcctattattttcctgatggaagaaaaggcaaaatcacatgcatggcatgtcacaaactagagaattcactgtgattgtaaattgttaaatctttaactacaaaacaagtccaatgtagtactgaactactgatgacaagttcttatcacagagtagctctttgtaatgaaatttaaaagctgattcgttcctccatttgtgcaatttgtttgcaggtatccttcagaggcactgactagctcatgcatgaccaccttcctgcccccgtggttgccatgagatcgaactactgcgcaattccgaattaataagcatggccgcatgcng

SEQ ID NO: 134 - DNA, 621 bp, Zea mays
  misc_feature (197)..(220): n is a, c, g, or t
  misc_feature (398)..(398): n is a, c, g, or t
  misc_feature (407)..(407): n is a, c, g, or t
  misc_feature (426)..(426): n is a, c, g, or t
  misc_feature (428)..(428): n is a, c, g, or t
  misc_feature (434)..(434): n is a, c, g, or t
  misc_feature (438)..(441): n is a, c, g, or t
  misc_feature (464)..(464): n is a, c, g, or t
  misc_feature (488)..(512): n is a, c, g, or t
  misc_feature (516)..(516): n is a, c, g, or t
  misc_feature (552)..(552): n is a, c, g, or t
  misc_feature (564)..(566): n is a, c, g, or t
  misc_feature (570)..(570): n is a, c, g, or t
  misc_feature (583)..(583): n is a, c, g, or t
  misc_feature (595)..(597): n is a, c, g, or t
  misc_feature (600)..(600): n is a, c, g, or t
  misc_feature (602)..(613): n is a, c, g, or t
  unsure (1)..(621): unsure at all n locations
ctacggtggcggtgagcagcggcggacggcgtcgcgtcagcgtgcacgacgacgacgaggaggaggcgccgttgacggtggaccccgccgagttcctcgacctcgatgcatggccgcctctgacgagcgaactctgccggccatagcagcgcttatttttataccaaagcaaccacgtcacttctttcgatttttgnnnnnnnnnnnnnnnnnnnnnnnnggaaatgtagaacattaagttgcaagcgtacgtgtacgtatcttgggttcgtcaacggcctaattaccatagttagcaagacctaactatggttttcacaaaaggtgcggactcgtattaagtattattggactcgagatatgcaataagatagcataatgacggtatttccaaactnaaaaaagcncttttcgttcatttttttncnttcagnatannnngtttggaaactccaatccccttngggattagagagaattgatggagnnnnnnnnnnnnnnnnnnnnnnnnncccnttcaattctgaaggaaatttgatttttcaaactaangttttgtcacgnnngagngacttgccatgtngagaatgggatnnngtngnnnnnnnnnnnnctgtgcac

SEQ ID NO: 135 - DNA, 476 bp, Zea mays
aaggcattttaataagtgcatgatcaatcataaactcaccaacttccaaggtttccacatcaaacacctctgaatccacgcttccctgcacgtcttctggaaataattgacgagcaatcactctctttcgagatccggcccatccgggactctcacttgtttgtggtaatgcagcacttttggttggatgcccctttgatgggaaacccaataacaggtcctcgaaaggatagcgaacagcagcagacgaatgaccacattttttgcaggacagtgtccgagccatctcaaacctaaaaatcgaatccatcattgtaggtgcatcactttgcttgttattattcttgtcgctttcattccaaatagcgcgcaaggccgtaagcaagtcgtggctgtcttccatagttccaatttgaaatcccgaaggatcacgcagatttaaacaattcaaaagtttaatcggattaaggacgcct

SEQ ID NO: 136 - DNA, 486 bp, Zea mays
  misc_feature (178)..(178): n is a, c, g, or t
  misc_feature (192)..(192): n is a, c, g, or t
  misc_feature (203)..(203): n is a, c, g, or t
  misc_feature (429)..(429): n is a, c, g, or t
  unsure (1)..(486): unsure at all n locations
agcacttgtcaatttggaaggccttgttgaagacaccagcatcaattgttctgattatctactgttttctttgtgtatggtttgtgggtggtttatctgtcttccatttgtacctgatgggcactaaccaggtaggtccaacattgattccagttcttttgtcattgatgctgcaacngcagttcagtagcntaatccttcanccatttttccttgtagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacacgctcacagtctaggggtttcatgagccccagcatgggcaagccaaccatnggagagcttgagatgggcaggaagccagtagtaccttgggacgagccaaggacggca

SEQ ID NO: 137 - DNA, 684 bp, Zea mays
  misc_feature (35)..(37): n is a, c, g, or t
  misc_feature (41)..(42): n is a, c, g, or t
  misc_feature (254)..(254): n is a, c, g, or t
  misc_feature (340)..(340): n is a, c, g, or t
  misc_feature (434)..(434): n is a, c, g, or t
  misc_feature (438)..(438): n is a, c, g, or t
  misc_feature (470)..(470): n is a, c, g, or t
  misc_feature (636)..(641): n is a, c, g, or t
  misc_feature (646)..(646): n is a, c, g, or t
  misc_feature (648)..(654): n is a, c, g, or t
  misc_feature (656)..(657): n is a, c, g, or t
  misc_feature (672)..(674): n is a, c, g, or t
  misc_feature (676)..(676): n is a, c, g, or t
  unsure (1)..(684): unsure at all n locations
gtttgatccgtgcgcgcgtgtctccgcccccaatnnntttnncctccttggcggcggtgttgcacatggcccgtggtgggctgcgggaaggggaacgtcgctgactcgacgccgctgctctgcacggcttatgcgcggcgcgtgcccggaatctgctcgtttgtttgctcgtttggtttgtgaatgcacgtggaaagcgtaattcctcccccgtggccgtgattttgccctcccgtggatcggcatgtgttttnattacgacctctctctatcgtcgcatctactgtactagtttttaccgtgcgcgcgcgcatgtgtgatgtgcgtctgcatcgtacgnccatgttgttgaattgtcaattagtcaggttggtttcttctttggcgttatttttgcgactttttcccatggcaccacaacgagtggtccgganttancttggtttattttcaaagctggccttttttcnccattctatgaacgggcatcacgaatgctgcatagtgctgcggctgtaggcacatctctgtctgctgcatatcttttgtcgtacactgacactagcttgacgcacaatgtgaattttacttaccaattaaaagaatgaggtttgaagcagtttaatttattttctnnnnnngggtntnnnnnnntnnctaaagcagatgtgnnncntggaataa

SEQ ID NO: 138 - DNA, 530 bp, Zea mays
  misc_feature (27)..(29): n is a, c, g, or t
  misc_feature (31)..(38): n is a, c, g, or t
  misc_feature (103)..(103): n is a, c, g, or t
  misc_feature (114)..(114): n is a, c, g, or t
  misc_feature (182)..(182): n is a, c, g, or t
  misc_feature (271)..(271): n is a, c, g, or t
  misc_feature (424)..(424): n is a, c, g, or t
  misc_feature (467)..(471): n is a, c, g, or t
  misc_feature (474)..(477): n is a, c, g, or t
  misc_feature (481)..(497): n is a, c, g, or t
  misc_feature (499)..(499): n is a, c, g, or t
  misc_feature (501)..(518): n is a, c, g, or t
  misc_feature (520)..(520): n is a, c, g, or t
  misc_feature (523)..(529): n is a, c, g, or t
  unsure (1)..(530): unsure at all n locations
aatttggtatgtgcttctgaagttctnnnannnnnnnntttggaagtgcacatcttgggagggctttagaaggacctgcatatttgttatcaagtaaaaaaancatataaagcnatctcattgcagctgtccggggagacaactagcaatatgtccgaagaagctcatttatagtcctactnctattagtatcacagaaaatgttctaaatagcatggtaaactaggatataaaagaatggaccaagttaatagccataacaagctccatnttaaatagaaaatagattacaaatctggatataggagtgcatcgagcttgtggatgtgaacagctatcagctcagtgtgtcactaagttttggagtacctgcatcatcaggtccaggaatgaataagaaacgactatgttcctttaatctagntcgagctgcaatcatctcgccaagctttccgaactgaaatctnnnnngannnncatnnnnnnnnnnnnnnnnntncnnnnnnnnnnnnnnnnnnangannnnnnnt

SEQ ID NO: 139 - DNA, 1420 bp, Zea mays
  misc_feature (13)..(15): n is a, c, g, or t
  misc_feature (27)..(27): n is a, c, g, or t
  misc_feature (88)..(88): n is a, c, g, or t
  misc_feature (153)..(153): n is a, c, g, or t
  misc_feature (162)..(162): n is a, c, g, or t
  misc_feature (164)..(164): n is a, c, g, or t
  misc_feature (170)..(170): n is a, c, g, or t
  misc_feature (194)..(195): n is a, c, g, or t
  misc_feature (217)..(217): n is a, c, g, or t
  misc_feature (221)..(221): n is a, c, g, or t
  misc_feature (244)..(244): n is a, c, g, or t
  misc_feature (250)..(250): n is a, c, g, or t
  misc_feature (281)..(281): n is a, c, g, or t
  misc_feature (284)..(284): n is a, c, g, or t
  misc_feature (296)..(296): n is a, c, g, or t
  misc_feature (321)..(322): n is a, c, g, or t
  misc_feature (379)..(379): n is a, c, g, or t
  misc_feature (397)..(397): n is a, c, g, or t
  misc_feature (425)..(425): n is a, c, g, or t
  misc_feature (436)..(436): n is a, c, g, or t
  misc_feature (447)..(447): n is a, c, g, or t
  misc_feature (506)..(506): n is a, c, g, or t
  misc_feature (645)..(646): n is a, c, g, or t
  misc_feature (714)..(719): n is a, c, g, or t
  misc_feature (743)..(743): n is a, c, g, or t
  misc_feature (745)..(745): n is a, c, g, or t
  misc_feature (751)..(751): n is a, c, g, or t
  misc_feature (946)..(946): n is a, c, g, or t
  misc_feature (1047)..(1047): n is a, c, g, or t
  misc_feature (1122)..(1122): n is a, c, g, or t
  misc_feature (1129)..(1129): n is a, c, g, or t
  misc_feature (1144)..(1144): n is a, c, g, or t
  misc_feature (1159)..(1159): n is a, c, g, or t
  misc_feature (1164)..(1164): n is a, c, g, or t
  misc_feature (1186)..(1186): n is a, c, g, or t
  misc_feature (1191)..(1191): n is a, c, g, or t
  misc_feature (1270)..(1270): n is a, c, g, or t
  misc_feature (1399)..(1404): n is a, c, g, or t
  misc_feature (1408)..(1410): n is a, c, g, or t
  unsure (1)..(1420): unsure at all n locations
gactttgtgttgnnnaatatctgaaanttggttttgctatttggcttattctctacttgttttcaccttccttttcactttgtttgcncaggaaacaagaatggacttctattgccacatactacaaccgaccaaggtaagcatttgctttangctgtgaangnttgctngatctgttattaatgcttacacanntggctggttatttcgaatctantaanttattacccagatgttttcacangcatgntgttatttccattttgtattgttcacttctnttnatgttttatttntcaagaaatgttagttttctatcannattcaccttcaagatgagttaattacataaggatactaaaagtaacactaggtttcncaaactaagtatataaancacttagtatgtcagatatgctgcctcntttgcctttgnttttgtaaacnctcagatttatattgtttacctgcacttagctagttccatggaaaacttttaggccttnggtatatcgtaccattggggagttatatggctccatcttggtaactgatgcatggccatgctgctgcttgcaaatccgcaatgactagatttctagttttgttcttttcaaatatatatctgtttgtctctaccttatnnctaattgacaaagaaaacggtgaggatagtggtaactatcctgtcaactgggctgtataggttatcgnnnnnnctggtttgccacaaatgatatgtnantttttnctccatgtgctttggaacttttgtagagcttcagcatctgaggaattgcttgcctgatcaagtggtggttcagcgcattgatgagaggttatctgcccttggcaattgcatagcctgcaatgaccatgttgcacttacgcaccctgaccttgacaaggtaaaatttacaggagactgaggagtttattctgtcgntagcccctgaaactctgcacatcctcgattacatcaagctaaaatctttgtgctaatgaattcaacaggagactgaggagttcattgcagatgtgcttggngtcgaggtgtttaggcagactattgctggaaatatccttgtggggagttactgcgccttctctaacaggggtggnttggtangtaaactgttagctncatttccattccatntgttncctaaagcttgcaaatgttgtntttantatttagtgaacgaatacatttatgcaggttcatccccatacatccgttgaagaccttgacgagctctccacgctcctncaagttcctcttgtcgcaggaactgtgaacagaggaagcgaggtcattgctgcaggcatgacagtgaacgactggactgccttttgtggctcggacacgacagccaccgagctctcagtcatcgaaagnnnnnnaagnnngagaagggca

SEQ ID NO: 140 - DNA, 743 bp, Zea mays
tgatgagcaaactaataacagtaaggagacagacagacacacacgcatggtggcgcaaatgcaaccggccggccggcgggcaagcagccaatcactctcccaggtgccgaccgcggatttgtttggtcccgcaggtgtcacccagcacaagaacaaccctaccacctgagacctgacctgaccttcgatcgggagagagcccgcccgcggccccgctacggtggctctcccggccggcacggggaggggagcaggcgcggcatcggatctgccaactcgggtctcggcaagcgcatgcaggcagcaagtgtttctgtgccagcagccagcagcacgcactcgcaagcctcgtccgtcccagacagtgcgcgggtgcatgcatgcgcggctaaagctagtagtagtaggtccgcgtgcatgcagcgatcaatggagccatcgagcttttctggctcgatttgatcggggaaaagagaggcaaagcaaaagccagagctagctagctagctagagtaagcgtggaggcaggcgtcgtatactcgtactgctagctccacacactcacacaccactggtacgagctctctcggagctggcgctggtggcggtagtgtccgccttttggaaccgacgcatccgatgtcggattggattagactggacgacggagagcgccactgccctgccctcgcacggcttgggcccccccgccgtgttgtcttgtctccatcaaggcatgcagg

SEQ ID NO: 141 - DNA, 757 bp, Zea mays
  misc_feature (3)..(5): n is a, c, g, or t
  misc_feature (66)..(89): n is a, c, g, or t
  misc_feature (135)..(136): n is a, c, g, or t
  misc_feature (584)..(586): n is a, c, g, or t
  misc_feature (595)..(596): n is a, c, g, or t
  misc_feature (598)..(603): n is a, c, g, or t
  misc_feature (611)..(611): n is a, c, g, or t
  misc_feature (619)..(630): n is a, c, g, or t
  misc_feature (644)..(644): n is a, c, g, or t
  misc_feature (648)..(650): n is a, c, g, or t
  misc_feature (655)..(656): n is a, c, g, or t
  misc_feature (659)..(662): n is a, c, g, or t
  misc_feature (672)..(679): n is a, c, g, or t
  misc_feature (681)..(681): n is a, c, g, or t
  misc_feature (683)..(684): n is a, c, g, or t
  misc_feature (688)..(692): n is a, c, g, or t
  misc_feature (698)..(699): n is a, c, g, or t
  misc_feature (707)..(718): n is a, c, g, or t
  misc_feature (720)..(722): n is a, c, g, or t
  misc_feature (726)..(741): n is a, c, g, or t
  misc_feature (743)..(748): n is a, c, g, or t
  misc_feature (750)..(750): n is a, c, g, or t
  misc_feature (755)..(756): n is a, c, g, or t
  unsure (1)..(757): unsure at all n locations
gcnnncagcagctgcctgcacaagtgggggtggggcactgtaaaaagagaggacttctgatgactnnnnnnnnnnnnnnnnnnnnnnnnataagccatggaattggattgcgtccctgtacatgcaagccccccnntatttccacgaggactggacggggcaggacttcatgggagtgtcagcaccttggacggggcagacggcggctggcttaacactcatctcatctgaagcaggtacagtacagcatgctcatcggccaggctcaggcgatcgtctggcatggcgaacttgaccggaccatggccggtgagtcgctcgctggcatgctgttgccccaccgccactccctccctccctcccaccccaaccagcggtcacgagtactaggcaaaatactttttctcctcctcctcctaaaaaaacgaaagggacgtgctgcgtgcagacggccggattactgccgctgccgcttcgtgcagtaggtttagtaggtacaggcacagtggcgcaggcaagggagacgacgacatgggcgtgcagcggcggcacctgaaggaaccagagaggatttccggggcccnnncgcggcagnnannnnnnaagaatgngcgtgccnnnnnnnnnnnnacaaaagctgactnctcnnngactnngcnnnntgctggtcgnnnnnnnntncnnctcnnnnnatcttnnatatatannnnnnnnnnnngnnntcannnnnnnnnnnnnnnncnnnnnnangattnna

SEQ ID NO: 142 - DNA, 1047 bp, Zea mays
  misc_feature (39)..(40): n is a, c, g, or t
  misc_feature (76)..(76): n is a, c, g, or t
  misc_feature (108)..(108): n is a, c, g, or t
  misc_feature (137)..(137): n is a, c, g, or t
  misc_feature (147)..(147): n is a, c, g, or t
  misc_feature (184)..(184): n is a, c, g, or t
  misc_feature (211)..(211): n is a, c, g, or t
  misc_feature (221)..(221): n is a, c, g, or t
  misc_feature (243)..(243): n is a, c, g, or t
  misc_feature (248)..(248): n is a, c, g, or t
  misc_feature (281)..(282): n is a, c, g, or t
  misc_feature (307)..(307): n is a, c, g, or t
  misc_feature (313)..(314): n is a, c, g, or t
  misc_feature (330)..(331): n is a, c, g, or t
  misc_feature (352)..(352): n is a, c, g, or t
  misc_feature (385)..(385): n is a, c, g, or t
  misc_feature (433)..(433): n is a, c, g, or t
  misc_feature (447)..(447): n is a, c, g, or t
  misc_feature (796)..(796): n is a, c, g, or t
  misc_feature (945)..(945): n is a, c, g, or t
  misc_feature (1005)..(1005): n is a, c, g, or t
  unsure (1)..(1047): unsure at all n locations
gaggtcccggcatggagcgagctgcgctactggatatcnntggccaaatctttgctgaccaggtttcttttgcacnctgttcctcgtttcttctcaggtaccatgccntgaaattggaagggtgccgataagcattnctgaaacttnaccctcgaatttaagaaggattccttatcatagaacntgcaaattactgaaaccagaaactacntataaatttnagtacaatgtgcatataccacnaaaancaagtataaatttgttcacggtgtgcaaaaaannaacagagtaactgtattcttgtttngatctnnaattttgaattgtgtnncaggggaaagcacttaatgcngtcgcctcgcggaacgcgaaagtcttagttgtnggaaatccctgtaacactaagtacgtatttctatatgttttggcaatncttaacgatttatnccatcgccttgtcttagttgtgggttgcccttgacgcagtgcgctgatttgtttgaaaaatgccccaaacataccggcaaaaaactttcatgcattgacgaggttggatgaaaatagagcaaagtgccaggtgactgaccttgaaactttatattatgtctcctcctcccattcctaacaggaaaaacagattaagcaatcacacacaatctcctttttgtagctggcactaaaagcaggtgtattttatgacaaagtatcaaacgtgactatttgggggaaccattcgacgactcaggtgaagatttgattctaaattaaacgagcagactattttgcagatacattncttcgctgattgttggcactgacttccctgcgtaggttcctgatttcttgaatgccaaaattgatggaagaccagtgaaagaagtcattaaggataccaagtggttagaggaagagttcaccctcacagttcaaaaggtatgtgcctcnccctgtttgcaatatgtttggtgttgcctgtcactcgagaaattaagtcaagactgcacnataatttattctgttcatatatctaaacagcgtggaggtgtg

SEQ ID NO: 143 - DNA, 256 bp, Zea mays
  misc_feature (107)..(108): n is a, c, g, or t
  misc_feature (213)..(214): n is a, c, g, or t
  unsure (1)..(256): unsure at all n locations
tgaggccacagcagtaaaagcagtcacgagatgtgaaacagacgagaacaagtagaacatcagcaacagactgcatgagcttgcaaggggaatcattagagcctgtnnacgatccaatgtaatggaagcctctgaaaaatccaagtttctctccatctctttgccatagtccagagctcgtgatgctgatgcataggccacagaaatggctgnngcaatgagggcaattgatgccgggtcgagcaagtaggtcagc

SEQ ID NO: 144 - DNA, 697 bp, Zea mays
  misc_feature (21)..(21): n is a, c, g, or t
  misc_feature (574)..(575): n is a, c, g, or t
  misc_feature (588)..(588): n is a, c, g, or t
  misc_feature (603)..(603): n is a, c, g, or t
  misc_feature (621)..(622): n is a, c, g, or t
  misc_feature (637)..(637): n is a, c, g, or t
  misc_feature (640)..(640): n is a, c, g, or t
  misc_feature (647)..(648): n is a, c, g, or t
  misc_feature (661)..(661): n is a, c, g, or t
  misc_feature (670)..(679): n is a, c, g, or t
  misc_feature (689)..(694): n is a, c, g, or t
  misc_feature (696)..(696): n is a, c, g, or t
  unsure (1)..(697): unsure at all n locations
gcaggtgatggaaatgacccngttccttctgaagatctgaaccattctgagagacatcaccaaaaggcataaagttaaaatgctgcctatagcataagacctaaatgaactgaataaatcacaaagttagataataaccaggtcttgggccaaacaggaagctgtttggactcagggtatcagcgataaaagctccttgtgttgggtcaatcggcattattgtatcaccctgtgatattggagtaggagagcttaaatattgcatgtcaggtggtactgactgctggtagtaaggagccgagaagaactgctgaggggagtagagctgaccacctccactaacagcatttggtacaggtgttgcaataggagaataatatgggtcataaccatagccaccatggaacatcaatgaggggtcctcattgtatacaaccttcaagaaaaagacaagtttagaggagtgacctatggcatatttatgacagaggaaaactttttctacttactggtggacccacttccaatccttcaacactcatgtagggaggatatgtatcccatgcttgtgtanngttttcagaaccngagcctgcccatagngagggaaactatgctaannatgcaacaagaactntcntcaatcnngatgaaagctgcnaaatctacnnnnnnnnnnagaaaacaannnnnntng

SEQ ID NO: 145 - DNA, 1087 bp, Zea mays
  misc_feature (9)..(17): n is a, c, g, or t
  misc_feature (27)..(33): n is a, c, g, or t
  misc_feature (79)..(82): n is a, c, g, or t
  misc_feature (85)..(85): n is a, c, g, or t
  misc_feature (97)..(97): n is a, c, g, or t
  misc_feature (99)..(99): n is a, c, g, or t
  misc_feature (128)..(129): n is a, c, g, or t
  misc_feature (132)..(140): n is a, c, g, or t
  misc_feature (142)..(144): n is a, c, g, or t
  misc_feature (146)..(154): n is a, c, g, or t
  misc_feature (156)..(156): n is a, c, g, or t
  misc_feature (158)..(159): n is a, c, g, or t
  misc_feature (161)..(168): n is a, c, g, or t
  misc_feature (170)..(171): n is a, c, g, or t
  misc_feature (173)..(175): n is a, c, g, or t
  misc_feature (177)..(179): n is a, c, g, or t
  misc_feature (181)..(184): n is a, c, g, or t
  misc_feature (186)..(186): n is a, c, g, or t
  misc_feature (188)..(191): n is a, c, g, or t
  misc_feature (194)..(207): n is a, c, g, or t
  misc_feature (210)..(210): n is a, c, g, or t
  misc_feature (213)..(214): n is a, c, g, or t
  misc_feature (216)..(218): n is a, c, g, or t
  misc_feature (220)..(221): n is a, c, g, or t
  misc_feature (223)..(226): n is a, c, g, or t
  misc_feature (229)..(234): n is a, c, g, or t
  misc_feature (236)..(240): n is a, c, g, or t
  misc_feature (242)..(245): n is a, c, g, or t
  misc_feature (247)..(250): n is a, c, g, or t
  misc_feature (252)..(252): n is a, c, g, or t
  misc_feature (255)..(256): n is a, c, g, or t
  misc_feature (258)..(264): n is a, c, g, or t
  misc_feature (268)..(281): n is a, c, g, or t
  misc_feature (283)..(290): n is a, c, g, or t
  misc_feature (292)..(296): n is a, c, g, or t
  misc_feature (298)..(302): n is a, c, g, or t
  misc_feature (304)..(306): n is a, c, g, or t
  misc_feature (308)..(308): n is a, c, g, or t
  misc_feature (311)..(316): n is a, c, g, or t
  misc_feature (318)..(323): n is a, c, g, or t
  misc_feature (325)..(334): n is a, c, g, or t
  misc_feature (336)..(337): n is a, c, g, or t
  misc_feature (340)..(342): n is a, c, g, or t
  misc_feature (344)..(350): n is a, c, g, or t
  misc_feature (352)..(355): n is a, c, g, or t
  misc_feature (357)..(367): n is a, c, g, or t
  misc_feature (369)..(376): n is a, c, g, or t
  misc_feature (378)..(378): n is a, c, g, or t
  misc_feature (380)..(380): n is a, c, g, or t
  misc_feature (382)..(383): n is a, c, g, or t
  misc_feature (385)..(386): n is a, c, g, or t
  misc_feature (388)..(390): n is a, c, g, or t
  misc_feature (393)..(394): n is a, c, g, or t
  misc_feature (396)..(396): n is a, c, g, or t
  misc_feature (398)..(408): n is a, c, g, or t
  misc_feature (410)..(413): n is a, c, g, or t
  misc_feature (415)..(419): n is a, c, g, or t
  misc_feature (421)..(431): n is a, c, g, or t
  misc_feature (433)..(438): n is a, c, g, or t
  misc_feature (440)..(441): n is a, c, g, or t
  misc_feature (443)..(444): n is a, c, g, or t
  misc_feature (446)..(446): n is a, c, g, or t
  misc_feature (448)..(452): n is a, c, g, or t
  misc_feature (454)..(454): n is a, c, g, or t
  misc_feature (456)..(459): n is a, c, g, or t
  misc_feature (462)..(466): n is a, c, g, or t
  misc_feature (470)..(470): n is a, c, g, or t
  misc_feature (472)..(474): n is a, c, g, or t
  misc_feature (476)..(482): n is a, c, g, or t
  misc_feature (488)..(488): n is a, c, g, or t
  misc_feature (490)..(491): n is a, c, g, or t
  misc_feature (494)..(496): n is a, c, g, or t
  misc_feature (499)..(499): n is a, c, g, or t
  misc_feature (501)..(504): n is a, c, g, or t
  misc_feature (506)..(510): n is a, c, g, or t
  misc_feature (512)..(516): n is a, c, g, or t
  misc_feature (523)..(526): n is a, c, g, or t
  misc_feature (532)..(544): n is a, c, g, or t
  misc_feature (546)..(546): n is a, c, g, or t
  misc_feature (548)..(550): n is a, c, g, or t
  misc_feature (554)..(558): n is a, c, g, or t
  misc_feature (560)..(560): n is a, c, g, or t
  misc_feature (567)..(567): n is a, c, g, or t
  misc_feature (576)..(576): n is a, c, g, or t
  misc_feature (580)..(581): n is a, c, g, or t
  misc_feature (586)..(587): n is a, c, g, or t
  misc_feature (589)..(589): n is a, c, g, or t
  misc_feature (604)..(604): n is a, c, g, or t
  misc_feature (608)..(608): n is a, c, g, or t
  misc_feature (628)..(630): n is a, c, g, or t
  misc_feature (634)..(634): n is a, c, g, or t
  misc_feature (654)..(658): n is a, c, g, or t
  misc_feature (668)..(668): n is a, c, g, or t
  misc_feature (849)..(849): n is a, c, g, or t
  misc_feature (859)..(860): n is a, c, g, or t
  misc_feature (891)..(892): n is a, c, g, or t
  misc_feature (910)..(910): n is a, c, g, or t
  misc_feature (919)..(926): n is a, c, g, or t
  misc_feature (931)..(931): n is a, c, g, or t
  misc_feature (942)..(982): n is a, c, g, or t
  misc_feature (1006)..(1006): n is a, c, g, or t
  misc_feature (1046)..(1046): n is a, c, g, or t
  misc_feature (1065)..(1065): n is a, c, g, or t
  misc_feature (1079)..(1086): n is a, c, g, or t
  unsure (1)..(1087): unsure at all n locations
gaccgcgtnnnnnnnnncggtgttctnnnnnnngccatgtcatacgccactgccgcctcctcttgtgttgctgttgtcnnnnacnccacaattatancntacttaaatttaacattaaaatagtattnntannnnnnnnntnnntnnnnnnnnncntnnannnnnnnngnntnnngnnngnnnnancnnnncannnnnnnnnnnnnngcncanntnnntnngnnnnagnnnnnncnnnnntnnnnannnntnatnncnnnnnnntagnnnnnnnnnnnnnncnnnnnnnnannnnngnnnnnannnanagnnnnnngnnnnnnannnnnnnnnncnngannngnnnnnnntnnnncnnnnnnnnnnngnnnnnnnngngntnntnntnnnctnncncnnnnnnnnnnntnnnntnnnnncnnnnnnnnnnntnnnnnntnnannangnnnnnantnnnncannnnnacgntnnncnnnnnnnctgccngnngcnnnggnannnngnnnnngnnnnntgatatnnnnctggcnnnnnnnnnnnnntngnnnaccnnnnncncgaagcngctgctccnccgnngcagnnangcgacgtactcctcncggngctgcccctccatctccctnnnctcntcgtcgtagccgctcagctnnnnngacattcatnagagcacagcccgaccgcggcttttgctgaaaaccgacgaagagagtactcgtagacacgcaccgggaagttgaggacggtgccggcggggccccagtacttgagcgccgccaggtcgtgcgcgcgcgccgccgcgtcctcgtcgtcgtacgcgcctgcgatgcgagcgccgaggagaaangcggttgagnngccaacgctcgggcagctgaccgactactcnnctagctgagctcatggcngctgagccnnnnnnnnatttngtgcttatgannnnnnnnnnnnnnnnnnnnnnnnnnnnnnnnnnnnnnnnnccatggagagctagcaaggagagnagctctgctcaccgagataaactgcaggcacgcgcccccngtccgtacgtgagcccggnccgcccgccaaccnnnnnnnnt

SEQ ID NO: 146 - DNA, 505 bp, Zea mays
tgttgaagaagcccaacgagccattaattccgcatatatagaggtaggctgatcatacttgctatgcaggctgttctgtagttgacattgtttagagatacaaaggtttatagaaagatgctgcatggagatgatctttgttttatttatgatgacactctttttaggcacgtagtgcttaccatggtattggcttggtcaaattaatgggaagaagcagcgggtttattgcaatgcacgcttccctttcaagtgggcaggtcgatgtctgcttaatacctgaggtaatataaatgtagcttttactatgtttaaaactgccatatgttttcctctcacatgtaagcgctaacagaagcttacaagttacaatatgaatgaaggtcccgttcactctagatggagaatttggtgttttgcggcaacttgagcatttgctaaagagtaagggattttgtgtggtttgtgttgcagaagctgctggacaagtatgctaaaattcaca

SEQ ID NO: 147 - DNA, 651 bp, Zea mays
  misc_feature (363)..(363): n is a, c, g, or t
  misc_feature (505)..(508): n is a, c, g, or t
  misc_feature (520)..(523): n is a, c, g, or t
  misc_feature (548)..(549): n is a, c, g, or t
  misc_feature (552)..(556): n is a, c, g, or t
  misc_feature (559)..(559): n is a, c, g, or t
  misc_feature (562)..(568): n is a, c, g, or t
  misc_feature (571)..(572): n is a, c, g, or t
  misc_feature (585)..(590): n is a, c, g, or t
  misc_feature (597)..(598): n is a, c, g, or t
  misc_feature (600)..(603): n is a, c, g, or t
  misc_feature (605)..(609): n is a, c, g, or t
  misc_feature (632)..(635): n is a, c, g, or t
  misc_feature (638)..(638): n is a, c, g, or t
  misc_feature (646)..(648): n is a, c, g, or t
  unsure (1)..(651): unsure at all n locations
ctcagccactgcaacacgcccgctcaggtacttgacttcactgggccctcagagttagccagctgcttgaaaggcgtggatgttgttgtcatccctgccggggtcccaaggaagccgggcatgactcgtgatgacctttttaacatcaacgcgagcatcgtcaagtcacttgttgaggctgtcgcggacaattgccccgaggcgttcatccatatcatcagcaacccggtgaattccaccgtgccaatcgcagcagaggttttgaagcagaagggcgtctacaatcccaagaagctttttggggttaccaccctggatgttgtcagggctaacacatttgtggcgcagaagaagaaccttaanctcatcgatgttgatgtcccagttgttggtggccatgctgggatcacaattctgccgttgctatcaaagaccaggccgtccgtcaccttcacagatgaggaagctgaggagctgacaaagaggatacagaatgccgggacannnntggtggaggcannnnctggtgctgggtctgctaccctgtnnatnnnnnacnctnnnnnnnganncgtcgagtcgtcnnnnnncgccctnncnnnngnnnnngatgtttacgagtgcacatttannnngtncgaggcannngat

SEQ ID NO: 148 - DNA, 511 bp, Zea mays
  misc_feature (72)..(111): n is a, c, g, or t
  unsure (1)..(511): unsure at all n locations
gccaagctactccacacacgcggattccacgtcaccttcgtcaacaacgagttcaaccaccgtcgccacctnnnnnnnnnnnnnnnnnnnnnnnnnnnnnnnnnnnnnnnnttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacgggtacctggacaccgtcgtcgactggatcccttgcgcgcccaaggacctgcaggcat

SEQ ID NO: 149 - DNA, 947 bp, Zea mays
  misc_feature (2)..(4): n is a, c, g, or t
  misc_feature (6)..(6): n is a, c, g, or t
  misc_feature (876)..(877): n is a, c, g, or t
  misc_feature (922)..(922): n is a, c, g, or t
  unsure (1)..(947): unsure at all n locations
annntnatcatatgaatccccattgcacctgttagccattgaggaaccataactataacctgcaaatgaaggattcacaataagaaaatcacaaagggaacctataatggaaaccgtagcatggaatgaagtagacaattctacagtggcaaaaggaacacggcaaaacaaaacaaagaacaaaaagcaacagaacagaagagaaggaatgatgacaataaaaattaaaaaatcgccactgccgcactgcgaacagctaatgaactggaaaatgcatttacttgagaatatcttcccacaatttgggtaataattgatcttattttacaaatccaaatatctccacttcattgtgttaaagctttgagcacaaagccagacaaatcattttcactaaaatatgttgattcatttgcgttaggatttatcacttttcaaagaaattgaggctttcttttgcaagaacattcagtgtacagtcaagtacacactatacggacttgtgaatctgctccacagagccatcagggaaggccataacaagggaagatcaaaacagcacctgattgagcatacattcatgctgctgcttcgcttatctctattcccaaatgccaaagttacacaattggcccagaggaagccagcagctgcttccactgaaacacacctgtattctccatattcctatggaaaaggagaaggcatgagtttcgcagacaactaaattattactgaacaaatcgggcgagatcatagtcattcctagaagaacagtaaagcaacccaaaaccaatttgactaaacagaaactcagccaataaacagataacgaaacattcagaatcccgacaaggatgtgtttgattcaacttnntgaaccaaattcactgccaaaaatctggaatcccaaccaaacagntacaacagcataatagattcttgaa

SEQ ID NO: 150 - DNA, 651 bp, Zea mays
  misc_feature (22)..(22): n is a, c, g, or t
  misc_feature (25)..(25): n is a, c, g, or t
  misc_feature (58)..(58): n is a, c, g, or t
  misc_feature (228)..(228): n is a, c, g, or t
  misc_feature (238)..(238): n is a, c, g, or t
  misc_feature (241)..(241): n is a, c, g, or t
  misc_feature (264)..(264): n is a, c, g, or t
  misc_feature (580)..(580): n is a, c, g, or t
  misc_feature (586)..(589): n is a, c, g, or t
  misc_feature (609)..(614): n is a, c, g, or t
  misc_feature (616)..(617): n is a, c, g, or t
  misc_feature (624)..(636): n is a, c, g, or t
  misc_feature (639)..(647): n is a, c, g, or t
  unsure (1)..(651): unsure at all n locations
ctgctccaaggacgtggtgtcntcngtgtgcttgggtatcaggtttatgttagccganacgctcagattgagcagcgtttccatcgggtacccggcaccgttggcggtaaggttagcgaagtggtttgtcttgagtatcctctcgatcgtctgaatcccgtagacgcagcgcctgaggtcctgtggatgctggaagtagttgaagctcacgctggggttgctatcgangtcggtgtcngcnagcaccagactgccagtcgacantgggccatcgatcttctcaagaatgaatcctccgtcaaacacttctttgggcaggctatgtttgttacgcacgtactcttggatttgatcaagacttctttgctttggtggaattgtagatatctgtccaatctgcgatgaatggagactttatatatgcatgtagaagatgaagaaaagaagaagacgacgacgacgaccaacctcagcagacatgattccatggtggcaatggatgctatcgtcggactggctgaaaccactgctggcttcaataaacaccccagcgtccgttatcccgacagtttcaatcaangactgnnnngtggggctcttcataggcannnnnntnnagttcannnnnnnnnnnnncannnnnnnnncgac

SEQ ID NO: 151 - DNA, 634 bp, Zea mays
  misc_feature (15)..(15): n is a, c, g, or t
  misc_feature (17)..(17): n is a, c, g, or t
  misc_feature (255)..(255): n is a, c, g, or t
  misc_feature (333)..(333): n is a, c, g, or t
  misc_feature (466)..(466): n is a, c, g, or t
  misc_feature (506)..(506): n is a, c, g, or t
  misc_feature (603)..(603): n is a, c, g, or t
  unsure (1)..(634): unsure at all n locations
cctttgagctgcaancncatgcattctaatctgccaccagatgtcagatggtgggttcagtcacagccaaattttgggatccagaaggatattgttagcaagcggttatgttcgttgggcagggacattcatgagaagcaagtggaagattcagtgccacaacctaaacatgaggaaacattactctgtcaagcagttgacaccagcactgaaaagattggagatgctttggagcctccatggatggtttcgccngccttcacgaagtattcccttgaaacaggcttagaagagatgaagactgttggtagctattctcaagtgtcgaagtgnatagaaactctcagcaattgtttgtacaaggataatgaattcccagattttgaatgtattgacccagcacctttgaagaacccagataaggctaattttgacatagatgcaccttggaaaggtgaaaagactngaccatggtggcagattgctgacgaggaccagctggcttnactggttgcagaaagagcaacacagcacattgagaattgtgacctaccaaggcctacccagacagtacgcattaacaggacagaaccatatactcanaaacatataggtgactttgggggaccttcat

SEQ ID NO: 152 - DNA, 848 bp, Zea mays
  misc_feature (150)..(150): n is a, c, g, or t
  misc_feature (208)..(208): n is a, c, g, or t
  misc_feature (235)..(235): n is a, c, g, or t
  misc_feature (245)..(245): n is a, c, g, or t
  misc_feature (250)..(250): n is a, c, g, or t
  misc_feature (312)..(312): n is a, c, g, or t
  misc_feature (328)..(328): n is a, c, g, or t
  misc_feature (601)..(605): n is a, c, g, or t
  misc_feature (667)..(667): n is a, c, g, or t
  misc_feature (714)..(714): n is a, c, g, or t
  misc_feature (717)..(718): n is a, c, g, or t
  misc_feature (735)..(735): n is a, c, g, or t
  misc_feature (805)..(805): n is a, c, g, or t
  misc_feature (807)..(807): n is a, c, g, or t
  misc_feature (832)..(832): n is a, c, g, or t
  misc_feature (844)..(847): n is a, c, g, or t
  unsure (1)..(848): unsure at all n locations
attctttcggtagtggatcatcgacactgccggggcctggtgcagcgcccgaagcagttcaagagattcgtagcttcattcatacgtcgcccgacgcttgtgtttgtttctgtcggaaacacgcctgttcaatgatttgagctgtggcgnttcactggtttgtagcaagaagggagcgaaggttcaggagctgggaattaatgcagtncctcagcacccacccaaagtgactagnccttggatcngtgcnggggattttaatgagattttggatgctcattcatgagcagttcggtggggtgactaggcctnaacgccaaatggatgncactgatcttggattcatacgattgcctttcacttgggataatcgtcagctagatggtaataatatcaaagttgacacatacatgctataattctacacaatcaaccagcacaatcaagcgctgccacataaatgcatcacaagccaaataagctcaactggtagcacaagattcattacaactaagctcacagcatgatcactctgcgttcaacttaaatgctcttacaggtaccaagcatatatagatcaaagtacggttagacaatttannnnngtctttgatctacttcataggttgcacaggcacatgaccagtaaccaccatattttcccaanatagaagtagccaacacactaaagccacaaaacactgatgaagttancanntgacataggggtaattnatcaccttagaacaggcagggacagctagtaatcagtgccaggacgcatagtaacaccttctatttagcncntagggaacatccatgtcgcaagaancatctcgtgctnnnng

SEQ ID NO: 153 - DNA, 471 bp, Zea mays
  misc_feature (280)..(280): n is a, c, g, or t
  unsure (1)..(471): unsure at all n locations
gacggaagggaaaaacttgttgaggttgaagggcagcgagtagaactcctcgctgcggctgtccgtcttgaagctccggaacttgtcccaccagtggtagcccctgtccctcctcacgccgctgtcacgcacctggatcgtgttgtccagtaagaaggccaccagcacagccacgaacggcttcgacgagaagggcacgttgatcatgtcgttgaactgccgacatccaaagccaatgatgagtgaacagccgttacaagtctcatttgcagtgcagaanaatgacatgcagagctagctccaattcacgtacccatcgggcgccggtgtgcacggggccatagccagccacggacgtgtactcgttgaagtattggggtactgacaggcccatgaacaaggagaaccccatgatgaacttggtcctgaagctgttcaggttgcagaactgaaggaagctcaggccacaag

SEQ ID NO: 154 - DNA, 764 bp, Zea mays
  misc_feature (75)..(75): n is a, c, g, or t
  misc_feature (418)..(418): n is a, c, g, or t
  misc_feature (495)..(495): n is a, c, g, or t
  misc_feature (520)..(520): n is a, c, g, or t
  misc_feature (535)..(535): n is a, c, g, or t
  misc_feature (566)..(566): n is a, c, g, or t
  misc_feature (582)..(582): n is a, c, g, or t
  misc_feature (643)..(643): n is a, c, g, or t
  misc_feature (657)..(657): n is a, c, g, or t
  misc_feature (660)..(661): n is a, c, g, or t
  misc_feature (667)..(667): n is a, c, g, or t
  misc_feature (676)..(680): n is a, c, g, or t
  misc_feature (687)..(689): n is a, c, g, or t
  misc_feature (693)..(694): n is a, c, g, or t
  misc_feature (698)..(698): n is a, c, g, or t
  misc_feature (705)..(706): n is a, c, g, or t
  misc_feature (709)..(709): n is a, c, g, or t
  misc_feature (717)..(717): n is a, c, g, or t
  misc_feature (722)..(722): n is a, c, g, or t
  misc_feature (729)..(729): n is a, c, g, or t
  misc_feature (742)..(744): n is a, c, g, or t
  misc_feature (760)..(763): n is a, c, g, or t
  unsure (1)..(764): unsure at all n locations
ttccaaacgatgagaccaagttatggccatggaaaaagtaacaaaatgatgtctttggctgacgaaaaatcaacnagtcagttacctgccaaccaatgccacgaccaagaactgaaggaggtatcatagtcgcacttgcatatcttgacacagcaatgaaggccccagatgactgaaagggtagcaaactgcttattagaacactattaattatggcacactcattttttcagttttgggtaaagctgcgcaagcaaacctcaacaagagcaacaaatgcggccaccatcattgcaaatgattcaccagcatcaaatgttggggccccccattggaaaggatatgggacactaatcctacaaaaacataattattgtcggtacacaaaaatgttacagccacagccaagaactgatgnaggtacctctattctgtaagaaattatacaaaagacaaggatcaaaagcaagaggcaatgcgattgcaacgaactcnttaccaaggagctccaccaacaagnccagagcggtcaacncggcaatggagttgtgtctttgttcgggcantcttgtaggcaccgcnaaccgtgagaatgtacgcatacagccatacaatcgcaattgtgaaaatcacagaaaaccgntcgaacacaggctntgnngcatgnacagcatgnnnnnagtactnnncacnngacngatacannagnacatgagntcagntgtactnctatgtatgatannntgtactctatactatnnnng

SEQ ID NO: 155 - DNA, 742 bp, Zea mays
  misc_feature (277)..(277): n is a, c, g, or t
  misc_feature (422)..(425): n is a, c, g, or t
  misc_feature (437)..(437): n is a, c, g, or t
  misc_feature (450)..(450): n is a, c, g, or t
  misc_feature (495)..(495): n is a, c, g, or t
  misc_feature (498)..(498): n is a, c, g, or t
  misc_feature (536)..(536): n is a, c, g, or t
  misc_feature (572)..(572): n is a, c, g, or t
  misc_feature (645)..(648): n is a, c, g, or t
  misc_feature (683)..(683): n is a, c, g, or t
  misc_feature (695)..(695): n is a, c, g, or t
  misc_feature (699)..(699): n is a, c, g, or t
  misc_feature (703)..(708): n is a, c, g, or t
  unsure (1)..(742): unsure at all n locations
gtcatggctctccggacctcggacaagctcgtaagccggtgctatgacctctgcgcctccttttcctttcacacaagtcgtacgtagccatatgtagattaccatgaaatagttctgagcggcgtggctccgatccgtccaggttgtcagcgacgacggcaggaaggtgcggcgggcgcagccattcaccgagcgacacaaagaagagctgcaggtgaactagtgtgctgattccgagcagaggacgacaaggtatttttagttcctcaaacaaaantgggctcactgatcactgtttgtgtgtaccggctcatgcagtgccggatggtcatcgccgagaacttgccgcaggattccacgagaaacagcctcgagaagatcttcggcgtcatcggcaggtcacacacgagaaacagcccatnnnngtagtttaattngtttgttctacgnatgttagccttgccatgtactagctagcgtctcttaaccgtgtgngcnacgagtttttttacagcgtgaaaaacatcagaatctgncatccgcaagaacccggctctgcaagatcatcaccnaggtcgtcagacacaaacacaccagccagtaacaaggtacttgtacttggtctttttttattttcatctcccnnnncagttcagttcagtattcttgttatagtactgtanctctcatcgtcntctnatannnnnnatgacagttgttctcttctgtccttcctgacaca

SEQ ID NO: 156 - DNA, 1032 bp, Zea mays
tgagttcccaacctgccagcatgtcttgttttttcttgaactcagttggttacactgctgccttagcatacataatgctaaggagatagtaagcatcgaatactgattttgcttgacaaattgagttgtacgattgttgatcagactacctagccatttggaactcagtggtttccacatacttgggtacttcgtacttcgcagttaagagaggaaactatgctctgctgtctgctaatctgtaatttatcaagaacaaacagtgttgtgggttacttgactgacagcaactgatgaaggattgaaacaacctcctaattaaggctgaacaaaatgaactcattttagcttaaagacagtgaaatctgagttaacgattccagttcctcacaattcaatttgaaccaatttattcacatggctttctttgagttcaattgaagctgtgcaggataatctcctactaacatctggttactgcattttttttgcatttattaggtccagaagcatatgcagatccgaatggaggcgaaccagaagtacatcgacacgatactagataaggcgttcaagatagtatctgagcaactgagtggcttcagcatatctgaccaagacctaccgattctcacctctgctagggccatgcttagccctgcagatcacttgagttcgtctgtcttcccccagctctccgtcagctccgttagccttcacaatcctggtcctggaggagggaaaggccttccgcatgttgccgacagccacgtgttctcccagaggccacctgaacaattcaagcgcaaatcacgttgagaagcattgctagctcgacgcagatgcatgacctgatcaagggcacactggaaaatcagaggaatttcgtctgacatgtgcacggtgcaatcgttcacccatcctcccgtagcacatctgtgaaaatcaaggttatcttggtctatttcggtacatctagactgacctttattaatatctaatgtaatgcctaagtggactagataagtaatt

SEQ ID NO: 157 - DNA, 645 bp, Zea mays
cctgtctccttcatcttggtcagcacaaatgcaccgacctgactcggtgagtactgcttgccatctgttgtttcaacccaagcatcaccatttggagccttcacgattttgtatggcaccatcttcatctctttctgtgtctgtggatcatcaaagcgtcgcccaatcatcctctttgttccaaagaaagtattctggggattggttactgcctggcgcttggctggagtaccaacaagtctttcacccttctgagtaaatgcgacaacagatggtgttgttctcgcaccttcagcattctcaataacttttgggttctgcagtcatttaatatagttatttaactcagcaataaaacaaatatgagagacaaaaatcatgaagggcaaaaatccttatgagtaactcacctttccttccataacagcaacacaagagttagttgtccccaaatcaatcccaataacctcatttccagcagcttttgcactgaaagcagttaccatgcaaattagcattactaaaatcagaaaagcgttaagaactcaaacaggagataattattacctaaaaggtcttgcaaaatttccccattttgagcatatgttggcagcacatgttgactgtaagttggcacccaggggt

SEQ ID NO: 158 - DNA, 989 bp, Zea mays
  misc_feature (9)..(14): n is a, c, g, or t
  misc_feature (957)..(970): n is a, c, g, or t
  unsure (1)..(989): unsure at all n locations
catgcctgnnnnnnttctaactgtgccatcaaatgtgaaataatgcacctctgaatgtctatcagctttgctactatagttcttctagaaacaattgttttcttgatgaactatagaaacacaattgaattcagaaagactgaccattttagcagtaaatataccggactacgatgaagaggctgaaacctggttggatatttgataacatgctaagtaaaaagaatgcaatcattagatatttgataacatactagctaaacaatctcaaatgtaaccaaatttagagtaaaaaaactccctgtgtcagatattgtattaagaagaagacctttctacgtctagggcggctcaccttctaaaattgagtccaggaattaggcgtgtatagacagggattcaaggaagcatatcattcattatttgccagtaacatcctttgcaaaatatcatgccaaataggtaggacacgcccatgaccatgaacatgaaccattggagggttgcatcagtcaaggtgtgtggtcccagcattttattgcaccgacactgtccgagcttggcagcttgccatcggcccatcacaaaactgcattttacccccttccacatgaggttttctatctttcaagccaaaaggaaaagcaaaaaaaaatgctgggagcaaatggaggccctacaatatctcccccccataaccctccgcggtgccctttggccattgaccaaatcctgtccaccctccaactcctccatgaaggcgaaagaacaaacggggtgaatcatctcctgtgccagactgccagtgcgtgacgggggagataaaagagggcaacagctcaaaaggagagccttttggtcttttccccccgcttctactgcaaacaaccatcatgggcgggcaaagctgcccctgcccagatcaatgatagagtgggcgacagtcagagacggcannnnnnnnnnnnnncggcgacagggggaatact

SEQ ID NO: 159 - DNA, 737 bp, Zea mays
  misc_feature (19)..(19): n is a, c, g, or t
  misc_feature (42)..(42): n is a, c, g, or t
  misc_feature (52)..(58): n is a, c, g, or t
  misc_feature (116)..(116): n is a, c, g, or t
  misc_feature (204)..(211): n is a, c, g, or t
  misc_feature (393)..(393): n is a, c, g, or t
  misc_feature (411)..(411): n is a, c, g, or t
  misc_feature (613)..(615): n is a, c, g, or t
  misc_feature (617)..(619): n is a, c, g, or t
  misc_feature (621)..(629): n is a, c, g, or t
  misc_feature (645)..(645): n is a, c, g, or t
  misc_feature (647)..(650): n is a, c, g, or t
  misc_feature (652)..(656): n is a, c, g, or t
  misc_feature (658)..(658): n is a, c, g, or t
  misc_feature (660)..(660): n is a, c, g, or t
  misc_feature (663)..(664): n is a, c, g, or t
  misc_feature (666)..(666): n is a, c, g, or t
  misc_feature (673)..(673): n is a, c, g, or t
  misc_feature (682)..(689): n is a, c, g, or t
  misc_feature (693)..(697): n is a, c, g, or t
  misc_feature (699)..(699): n is a, c, g, or t
  misc_feature (702)..(736): n is a, c, g, or t
  unsure (1)..(737): unsure at all n locations
tggcttaaacaatacatcnccaggtcaaagggttaggttttnctatccagannnnnnngtctcccagccactgccaatctgcaacggctcgtccccctcgcctttaattatgcccntcactgagaacactagattaacttactaaagcaacccacaccaagtacccaaaaaaaagtcataagcaaacacaacacaaggcacagnnnnnnnnccgcacagcacacagaaaggaaagcaagcagtgcatatatctgatctaccactaccaaacaatgattgatttcacaggtgtggagtgcgatgatgccaaccgctcgccacttcggcgtatccatgggctcgtggcttcggccggcgctctataaggtataagtttccggtgtatgcagccangcggtaggggcggggganctggattctggggcgacaggatggggatgtacggcagcagatagagaggagtgcgctgcccattcgcgcttttgcagagggggacaaaagaatcctctcggcttgcaccgctgctgctgagaaggatgtgccaactatgccggtgtcatcttgcactaatagaggtcttcgagaatcaagagaactttttttgcacgggatnnngnnncnnnnnnnnnctctcaatctcgcagncnnnnannnnntnancgnntnatctttncatcaccannnnnnnntcannnnngncgnnnnnnnnnnnnnnnnnnnnnnnnnnnnnnnnnnnt

SEQ ID NO: 160 - DNA, 1109 bp, Zea mays
  misc_feature (432)..(435): n is a, c, g, or t
  misc_feature (442)..(444): n is a, c, g, or t
  misc_feature (458)..(460): n is a, c, g, or t
  misc_feature (482)..(494): n is a, c, g, or t
  misc_feature (499)..(538): n is a, c, g, or t
  misc_feature (552)..(553): n is a, c, g, or t
  misc_feature (567)..(567): n is a, c, g, or t
  misc_feature (569)..(569): n is a, c, g, or t
  misc_feature (571)..(571): n is a, c, g, or t
  misc_feature (580)..(583): n is a, c, g, or t
  misc_feature (604)..(604): n is a, c, g, or t
  misc_feature (608)..(609): n is a, c, g, or t
  misc_feature (616)..(616): n is a, c, g, or t
  misc_feature (622)..(622): n is a, c, g, or t
  misc_feature (624)..(624): n is a, c, g, or t
  misc_feature (628)..(628): n is a, c, g, or t
  misc_feature (652)..(658): n is a, c, g, or t
  misc_feature (662)..(670): n is a, c, g, or t
  misc_feature (684)..(684): n is a, c, g, or t
  misc_feature (795)..(795): n is a, c, g, or t
  misc_feature (797)..(797): n is a, c, g, or t
  misc_feature (842)..(842): n is a, c, g, or t
  misc_feature (855)..(855): n is a, c, g, or t
  misc_feature (881)..(881): n is a, c, g, or t
  misc_feature (926)..(926): n is a, c, g, or t
  misc_feature (935)..(941): n is a, c, g, or t
  misc_feature (971)..(971): n is a, c, g, or t
  misc_feature (979)..(979): n is a, c, g, or t
  misc_feature (986)..(986): n is a, c, g, or t
  misc_feature (1030)..(1031): n is a, c, g, or t
  misc_feature (1058)..(1058): n is a, c, g, or t
  misc_feature (1091)..(1092): n is a, c, g, or t
  unsure (1)..(1109): unsure at all n locations
tacatgtacatgtacatgccagtaggattcgagcaggcaagtagcactagtagcttccgatccggagcccgtcaaggctgcgaccagaccagagaccaccgaaatatgctcgcctccggcggcaggaaggcacgggagtaaagccaactcaaggaataactaacgggtgccgcgctgtaagccgcgaagcgagcacgacaggaatccgcgaggtcaggagtcaaaaacccaaaaccaaaagggcaggcagagcatcagggtgcgcagagcccggctgctggactagagcccaagcaacgaacatgccacgcgctgtgcctgtgccttgacctcagagcactctacagagccagctgtgcctcctgtaagtcctaatcatggctaaagtctaaagacacaggccctcgttccaaggctgacaatccggacgcnnnngttcttnnntaacattctgaatnnncacaacttcacagcctcacacnnnnnnnnnnnnntctannnnnnnnnnnnnnnnnnnnnnnnnnnnnnnnnnnnnnnntgattagtagtgannatggtagccccagncngnacagctgtnnnnagccaaggatggatggacggngtcnngggtgcnaccggnantcantgccctgtagctgcacgagtacgnnnnnnntttnnnnnnnnnaagaggaggagcgncgaggaaaattattagatccgaggacgtcgatgattgtatctacgtacgcgagtccacgacggaatcggaattaggcgactagctttcttgggacaacggacggaagatanancgggtgacaccgtgacaggagagaagaatccagaatcctttctcnaaacgggacgaanaaaagtgtgttacctgctgaacccangcccctttctggagctcaacaaggcgctaagcatgtcttccgganagaaggcannnnnnntgtgtgccacgctgcctacctgatcgactngcctctcnatccagnatgattttgcagccatttagcatgtcatggaaagaacactctgnngtaacggactaaacggtagttgcatancgcgcagcagacggggtcagcggtattgaatgnngaacgtgcttatatgct

SEQ ID NO: 161 - DNA, 720 bp, Zea mays
  misc_feature (9)..(9): n is a, c, g, or t
  misc_feature (15)..(15): n is a, c, g, or t
  misc_feature (23)..(23): n is a, c, g, or t
  misc_feature (50)..(50): n is a, c, g, or t
  misc_feature (93)..(93): n is a, c, g, or t
  misc_feature (106)..(106): n is a, c, g, or t
  misc_feature (310)..(310): n is a, c, g, or t
  misc_feature (322)..(322): n is a, c, g, or t
  misc_feature (394)..(394): n is a, c, g, or t
  misc_feature (549)..(555): n is a, c, g, or t
  misc_feature (579)..(587): n is a, c, g, or t
  misc_feature (591)..(592): n is a, c, g, or t
  misc_feature (595)..(607): n is a, c, g, or t
  misc_feature (616)..(622): n is a, c, g, or t
  misc_feature (628)..(628): n is a, c, g, or t
  misc_feature (637)..(645): n is a, c, g, or t
  misc_feature (654)..(665): n is a, c, g, or t
  misc_feature (669)..(718): n is a, c, g, or t
  unsure (1)..(720): unsure at all n locations
ctccactcnctcttncgtacctnggcacaagctacgctcacaggcaggtngctgcacccttccctactccacaatgcaaaacactagcagagncatggccaaatcnaccaatcggggatgactggcaggagacggcactgccaaatcaattaatgagcatgccaaagaggggcaggacagtggctagcggaggctggatgctggaatggcggcatggctggaacctgtgtgcagagcaccgtgcttgtgctgttgtgtacatggacgatcgtcagccaacgttggagagcatggcagcaccagcactccnacaggtaatagnattccccattccaaaatatctattactacccattcacgtggtgatgccagttgtgagcacagccagtggccnagcgtgacacaaactgaagaggaggacaaataactgatttttttctactgtggtcatatagttagctactacaaaaattaggaataaacaattaaccttctctatgaaaaaaatagataatctcagcttactagcatgatatagcactaggattnnnnnnnttgcattgcatgcatctagttctnnnnnnnnnttannagnnnnnnnnnnnnnaaaatgacnnnnnnncatgcnacgtatcannnnnnnnnaaaaaaatnnnnnnnnnnnnctannnnnnnnnnnnnnnnnnnnnnnnnnnnnnnnnnnnnnnnnnnnnnnnnnat

SEQ ID NO: 162 - DNA, 569 bp, Zea mays
  misc_feature (256)..(256): n is a, c, g, or t
  misc_feature (445)..(462): n is a, c, g, or t
  misc_feature (468)..(472): n is a, c, g, or t
  misc_feature (476)..(482): n is a, c, g, or t
  misc_feature (484)..(567): n is a, c, g, or t
  unsure (1)..(569): unsure at all n locations
ccggagaaggtgacgtgggtgagggccttctacgacgacttgggcgccttcaccagggaccaggagctgctggtgtcgattccggattcggtggactacgtggaagggttcatggtcctgaacgagcggtccctccacagctcctccatcgccttccccgcgagcgtggacttcagcccggatttcggcaccaggagcagccctaggatctactactgcgtcgagttcgcggtccaccaccaccacggttaccagnagcagtctcaggcggccgtggaggccatctcgaggcggatgagccacatggcgtcccagctgtacagcgtggaggtgtcctacttggacttcctgaaccgggtcaggatggaggaggtgagcctgcggagcgccgggatgtgggaggaggtgcaccacccgtggctcaacatgttcgtgcccaagcccnnnnnnnnnnnnnnnnnngatctnnnnntggnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnntg

SEQ ID NO: 163 - DNA, 844 bp, Zea mays
  misc_feature (97)..(97): n is a, c, g, or t
  misc_feature (99)..(99): n is a, c, g, or t
  misc_feature (178)..(178): n is a, c, g, or t
  misc_feature (201)..(201): n is a, c, g, or t
  misc_feature (218)..(219): n is a, c, g, or t
  misc_feature (239)..(239): n is a, c, g, or t
  misc_feature (260)..(260): n is a, c, g, or t
  misc_feature (330)..(330): n is a, c, g, or t
  misc_feature (691)..(691): n is a, c, g, or t
  misc_feature (709)..(709): n is a, c, g, or t
  misc_feature (793)..(793): n is a, c, g, or t
  unsure (1)..(844): unsure at all n locations
cgcggtaaacccatgttatgtatctcattgatgaacatgactcaaaacaaacactactcaaaacttcatttaattagagacaatttggcatgtgttnanaaaaaaggtaaaagtagactgctctatacagatttaggaataacatacgataagccgcactagaacatctgattcctangtttctcatggaatatatataanagaagcaacaaaaaaannaaagataagaaatgcactgntaagttataaatgagataagnaatgcactgccaagttaataacgagataagagatgcactgctaaggtaatgtgaaaagctgcaccactgnaaaaaaaaatctgaaacttctgctcaacaatgtgtgagacagggcatacccatatccttcttctgaccatcccgcagtaaaaattccttctgcggtcgtaaagccttgatgctccattccatggagcagcatatttgcagcaacagcgtatgtaacaccagtccagatttcacgtgattgcatgcatgtctcgtccacctttccctttggagtcataccatttacagctcccatccgtcctcctttaaccttcatcacattgaattcaaatattttttgcagagcagttcttatcttgtgctcatcgaaaagcgggggcaagcccgacgaggcagcataccactgtcctgccagctgatcngcctgaatggatctactnttgctacttgtgccgctgtcgtaattgaaatatgacccattccataacttcgcctcatatactgctttggcttttataaacttnagcttgtacttctcagcaaagtgccgatccccaaggcgatgagccattgta

SEQ ID NO: 164 - DNA, 483 bp, Zea mays
  misc_feature (185)..(185): n is a, c, g, or t
  unsure (1)..(483): unsure at all n locations
gtacccctgggaaacctgcttctgcaatcgctcattctcctccatgagaagcttgttcattgcagtcaactttctgttcacggactggagcctcgaagactcattgcgttgcttgtcacggcacctaacaccatgaaagaatgggcacagaattcagctagagcggacaaatcagaatcagcatngctatagtaaagggctggcgaaaatcaagaagacgaactacgttttggccatttgctcagaatagcatggaacagactttcaggtttgcacgacatcattacgatgtttctacggctattcgttttaccaatcacatcattacgatgtagaaacaaaaggattcatcgagattcacttcctcgaggataagctccaacagatttgctgactaatttgtcagcgctcacctccggttctggaaccagactttaatctgcttggcctcgatgtttgagaggatggggcactcgcgtagca

SEQ ID NO: 165 - DNA, 430 bp, Zea mays
tgattcgagaatcggatggaaccaaatctgattgcaaaaaagcaagccaagacttggttttctccaatatctcatgttcagttggtcagatgatgtgtatgtgtactggtgcactgcagcttggacatgacttgtctgaagaatttgaagctgaaggtgagtgttggagggaaccaaatctccagctgcatgcacagcacaaggtttggtttcctccaatgtctcatcttcaactgtctcaaatcaatgcaactttgcaggcattttcaggatcattatccttatccttatccttatccttatccttcacagagtgaccaaatacagtattttcagttaaccaaatagtgagctacaattgattggaagctaatggtatctgagttgatgagttgctccatatcttgttatacaattgattggaagctac

SEQ ID NO: 166 - DNA, 883 bp, Zea mays
  misc_feature (747)..(754): n is a, c, g, or t
  misc_feature (867)..(867): n is a, c, g, or t
  misc_feature (875)..(876): n is a, c, g, or t
  unsure (1)..(883): unsure at all n locations
taactagcaaagctaaataactttgtccatgttgtcttagtattgttctctgtgtaattttatattctgaaagtaaggaacatgtgcataagtactctcaatttagattgtagaatcatttatgcctttttcttgagaactacatccattgcacaatcgataatgttcctctcccgttgaaatattggaccagagaattatggtctcaagaaatgctgttgttggtgcttcttacggccttctctaccctaaataggtgaatggtgtttggcaaacgaagcagccgaatatgatggagctgtgcactgaagcgagaaagctaaaagagaacttccattcctttgagatcatccatgttcgacgggtatgcattgcatttatagttttacataagcttgcagactctttggttttgcatcatagacattattggtcaaaacagatattctttgcaccacaatcgatgttatttgcaagtgctggccacctgtatatgctttagttaagcaagctaccacagcaatggttgctttcatcagattgaaagaaaataataaaaaaaagaagcattagtttctattgttcttctaagtgctctgctgattttacccctttcctgcttctgaatgaaggagtggaatgctgaggcggatcgtcaggcgaacatcggtatcacgcttgcaagtactacacaacatccatcatccctcaattccagttttcttttcttattttcataaaaatcannnnnnnnctgactacgctacattgcaggtggcgccgtgtttgaggagcgtggtgacatctgatacatagctagcaacgtatgtagttaactaactagcttgacctttgacttgcaccttngtcgagcnnctatgct

SEQ ID NO: 167 - DNA, 614 bp, Zea mays
  misc_feature (104)..(108): n is a, c, g, or t
  unsure (1)..(614): unsure at all n locations
caacaacaacaaaaccagaacagaccgactaattaagcaaaggtacacacgtacctgcagctagcatttcttcgacgtcgtcgctgatgcacgtacgttacgtnnnnnaacgtaacgtaggtgcttacatcaaggacttgagcgaccgcgccttcacgggcttcctccaccgcttccacgggatcttcgtcttgacatcaccactgctagctttgggatcgccattcccgttcatgctgtggccagagataccaagtccatcgaagtcgtcgtcgtcgctgctcccctcatccacgccggcgatcgtccctgctatgtcatcttcgcagctagacgtatcaccataggctgcagtggcggtctggttggtggtggtgtcatcatgatgaccctcatcgacctcagccttctgacccggagaagcatgttttgcctgattaccctcgtcgtcttcccttgcaggcgcaggttcgttcgtgccgccgcttttacactgcctcttcgttgaccggaatgggccgaacccagcgtagtagtagaagccctcagtcgcactcacgtcactgccaggcttcttcttcctcggcttgttgcgtgcggaggacttgggggca

SEQ ID NO: 168 - DNA, 526 bp, Zea mays
  misc_feature (56)..(56): n is a, c, g, or t
  misc_feature (69)..(69): n is a, c, g, or t
  misc_feature (81)..(81): n is a, c, g, or t
  misc_feature (106)..(106): n is a, c, g, or t
  misc_feature (229)..(229): n is a, c, g, or t
  misc_feature (347)..(347): n is a, c, g, or t
  misc_feature (405)..(405): n is a, c, g, or t
  misc_feature (468)..(476): n is a, c, g, or t
  misc_feature (479)..(483): n is a, c, g, or t
  misc_feature (487)..(493): n is a, c, g, or t
  misc_feature (495)..(502): n is a, c, g, or t
  misc_feature (507)..(517): n is a, c, g, or t
  misc_feature (519)..(523): n is a, c, g, or t
  misc_feature (525)..(525): n is a, c, g, or t
  unsure (1)..(526): unsure at all n locations
aataggtagtcaatcaggttcttgtttgtaatccgaaatggcctaggacctgaaanacagaggaatttnaattgcaaattntattgagattgttttaggtgttctntagaaaaagtttctacctgttagctccttacgaagaccatcctccgcatcagtcttgctaacattgggattgatctctaaaccgcttctatatgcagctatgctttttaatgcaacaatttgnttagaaactgtgagcaataagttaaggatatttctaaatcaaaaggaactaaataaaaataatccaattggtttgcaaagggtattggaaaatgtagaggatatgaattcagcttagntatgtagctttcagtgaatgagtccagtgtccaccttgatccactgaatgactcctgnaaatggtatttgtgcaagttgattaaaattactttttaaaaaagtactcgtagttaaaacatnnnnnnnnntannnnnagcnnnnnnnannnnnnnntatannnnnnnnnnnannnnncnc

SEQ ID NO: 169 - DNA, 844 bp, Zea mays
  misc_feature (1)..(4): n is a, c, g, or t
  misc_feature (23)..(25): n is a, c, g, or t
  misc_feature (57)..(57): n is a, c, g, or t
  misc_feature (87)..(87): n is a, c, g, or t
  misc_feature (101)..(101): n is a, c, g, or t
  misc_feature (134)..(134): n is a, c, g, or t
  misc_feature (167)..(167): n is a, c, g, or t
  misc_feature (247)..(247): n is a, c, g, or t
  misc_feature (253)..(253): n is a, c, g, or t
  misc_feature (286)..(286): n is a, c, g, or t
  misc_feature (302)..(302): n is a, c, g, or t
  misc_feature (420)..(420): n is a, c, g, or t
  misc_feature (631)..(631): n is a, c, g, or t
  misc_feature (722)..(722): n is a, c, g, or t
  misc_feature (823)..(823): n is a, c, g, or t
  unsure (1)..(844): unsure at all n locations
nnnncagctgtggacttgagggnnncaccattgttcagttgaaccctagaagaaacnggaaacagggcaacatgtaggaaacaatgngcacaatctgcacnggtaggagaatccatctaatcaaacatcttcgnatttctcttaacaaaaagacgagcgattcatcngcaaagattgggctgatctaaccaagagaagagggaatcaacctgagctaggatggatctccaccctatgccaatgtggncggggntaccctgccaagagcgaacccgctcgtgacctngccgtctgtgaggacnatgaaacccaggcggttcccgccgtctccttggccctactgcacgtctaggaccttgactgcctcctcgaaggccggcacgagcgcaacactgccatggagcgagggcatggaccccncacatgcgcggcctggtaggcggcgagcgttgagtctgtctcctagtaggaggacggggaggggagggatgaatttgattagattagagggtggcggcgctagctggaaagctatcatattttgtatccttatccaatcacatgtggtactgtttgttaggcgagaagcggggaagagaaacaaatctaagcgcttcacacgacgcacggngatggaaactcgtgctttaaaggagtacaaaatatgctattcatcactctaggtgatgatcacccaccctgcaatggcttagcataaaccntgaatggcttaacaagtaatgaaaatttgttaagccatttcagagtcggtgatcattggtgacaaatataattcggagtacaaataacagttgtcaattancttctttgcttgtctagattc

SEQ ID NO: 170 - DNA, 474 bp, Zea mays
  misc_feature (95)..(127): n is a, c, g, or t
  misc_feature (278)..(279): n is a, c, g, or t
  misc_feature (283)..(285): n is a, c, g, or t
  misc_feature (287)..(290): n is a, c, g, or t
  misc_feature (292)..(293): n is a, c, g, or t
  misc_feature (351)..(351): n is a, c, g, or t
  misc_feature (369)..(372): n is a, c, g, or t
  misc_feature (374)..(375): n is a, c, g, or t
  misc_feature (415)..(415): n is a, c, g, or t
  misc_feature (430)..(430): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (468)..(468): n is a, c, g, or t
  unsure (1)..(474): unsure at all n locations
aaaaaaaggagagaggacttagagaggaaacgaactagagacaaacaaggctaggctaaagagcggactttggagccctagacagccttttctannnnnnnnnnnnnnnnnnnnnnnnnnnnnnnnnaaccgtacctgcgcatcaagatgcacggcacgtagtacctgcaactgcaagtaaggataaacagaaagctgcctttgaacgtcagtcactagctagctaggcgtgtatgcagatcgatcgatgagcagcccaggtgacggggggcacaganntgannnannnntnngatgggaagagggtcagtgaatgagtgagtgattgtgcaacttttgctttcactgtanggtgagagtttgatcccnnnntnnggtgtgtgcgatgcatgctcggccggtgttccctccaccntttgcccacttcttnttttttntntntgcccttttctccaattccattggtcntctctg

SEQ ID NO: 171 - DNA, 464 bp, Zea mays
  misc_feature (88)..(88): n is a, c, g, or t
  unsure (1)..(464): unsure at all n locations
gacctgacccaactctgccagcaagaagacagccaagaacaagaggcacaatctgcgcgacgccatggccaagtcgaagccgaagccnaagccaggacctgcagcctggagcccagcctgccatctacagagacctgcagcacgccggcgacgatcaggaagagctcctcagacaaccggctgcaagggaagcggccgcccaggctgctgatcagctcaaacaacatagcgccgctgccgcccaccacgcacagcaacgccgggccatcgcccggcgggaaggacgacgtggacccggactcggccatgatgggcgagtgcctcgacttctgcaagcgaaacctgttcgcggaggacgggtacgaggaccgctacctggatgacctcgcggagctgccggaggcgctgatcctgaaccgcatcaactccaagcgggccatgcactcgtaccagctcgggaagca

SEQ ID NO: 172 - DNA, 628 bp, Zea mays
  misc_feature (489)..(490): n is a, c, g, or t
  misc_feature (582)..(582): n is a, c, g, or t
  misc_feature (584)..(587): n is a, c, g, or t
  misc_feature (598)..(598): n is a, c, g, or t
  misc_feature (614)..(616): n is a, c, g, or t
  misc_feature (618)..(624): n is a, c, g, or t
  unsure (1)..(628): unsure at all n locations
attccggcgacggcgtgggcgcccttcttagggtactgcccgcccaacttggagtccatgatgcggtacagacggcccttgtcgctcaagtagggtctcgcccactccaccaggttctgctcggttaatggtttcgacttgtctagcgcccgccgtcccgtcagcagctccagtagcaccacgccgaagctgtagacatctgccttcactgagagccgacctggagcagtttttaacaagacgatgcatgaggaaaaacaatcttgccaaaatgaatagtgtggccgagcagattatcaatatactggctttatgcccaagcttaagatttgatctggtacatgtggagatctctctactctctaatgcgtactcctacgtgcctgcacgaattagagggggtattccctgctgtgttccacttccttcaaaaggattgaataaaaggtatctgagctccccacggagatcacgaatggaatataattnntgaatctacccttttgaactgttcaattgcatgaaaatttagaccctatttagcacaacttattttcagcttcttcgcagatttaaacagangnnnntaccaaacagntatcccttgcagtagnnnannnnnnnagct

SEQ ID NO: 173 - DNA, 617 bp, Zea mays
  misc_feature (20)..(20): n is a, c, g, or t
  misc_feature (255)..(255): n is a, c, g, or t
  misc_feature (581)..(583): n is a, c, g, or t
  misc_feature (593)..(595): n is a, c, g, or t
  misc_feature (597)..(614): n is a, c, g, or t
  unsure (1)..(617): unsure at all n locations
ctaactcactgccttttagnttttttttgttgattgtaattgaaacaactggacaaaaaagcatgcacatgcagagttgtgggagcgattctaccgttattcctacaaactcggacgccacgaactatattcgccacggtctccatggcacacaactggtcaccatgcactccgtggactcaggcatgcacctgaccaactcaaaacgtgacagtaaagtaaattaacagagctgagcaacaagtttatcttctnacaactaggtctgacatacatggaccctgatttttggacaggttaacggaaaccacgaaactatgaatgtggaaggtgatttccggtactgtgatccgggaggctttgatgagtgcatgcgcttccttgactacttggatgaatgtgatggcaactgggataacgcatttctcaactgggtaaatgtctgtgaaagacggaagaaagagtatgtagctttgcctaatggtgactggggtccttggaatttcgtcaaggtaaacaagaatcttgtgctggacacttgatagacaatctatatattcttgtgcttctgaaatgctggnnntccgatattnnnannnnnnnnnnnnnnnnnngct

SEQ ID NO: 174 - DNA, 459 bp, Zea mays
tttctccttcaattctcttcgtgggaaaatcgttaacgtaagttgtaactttttttttggcacttctcgctattgtttcgacatctttatttcttaagaagtcctgaacctgaattgtaatgcgattttcttgcacctgtctacccgtcatgcagcgggattttgccagcaatcaacttgataggcgacagcgtcattgttggggtgagtgagtgagtctaccgctattattcagtctgaatccagtaaatcagaattccacaggataatagtacctatatttcctgcaaagacaaatttttacatacatcaaaagcatctcgcatggcatgttttatgtggacacgacaataactccgttcttggatgttaaaactattttgacaatctccagatcttctacttcattggctttgcattgttctgcctggaggctttgctaagcgtgtgggtcattca

SEQ ID NO: 175 - DNA, 611 bp, Zea mays
  misc_feature (9)..(9): n is a, c, g, or t
  misc_feature (166)..(166): n is a, c, g, or t
  misc_feature (238)..(238): n is a, c, g, or t
  misc_feature (528)..(530): n is a, c, g, or t
  misc_feature (553)..(554): n is a, c, g, or t
  misc_feature (601)..(610): n is a, c, g, or t
  unsure (1)..(611): unsure at all n locations
atataagtnaattgatcaaaaagggtaaacatttttttctacattaggcccaaaaatttagacccacgagaaagtcgacaacaaaacagaacagaatagtgtataccgaaaacatataataccaaaaaatacatacttctcttcaaattttggattcaattgcttnattggttcgggcttcttcttccgcattcggaggggctcccttgaagcatagtgttcatcacttctctttttnatcaagtcaatgacttcatggaaaatgtcttgtaacgatccaggcaactcagatctatccaaaatttcttgcagcaaagaggaaattggaaggaagatttccgggaaagaagatagcccttcatgtataataacaaaacctcttaaacattctgccacagataaaagtacaccagccctgccagaaaatatactgactgtaagacaacaaaaaagaaacccctctgaacaatcatgaagccattacaaccatatacttacttaaagttatcagatgagaaataaggggcnnnaggatccatgccaactatttctnngatattcactggattcacctcatgcacatggtcatggatactgagcnnnnnnnnnna

SEQ ID NO: 176 - DNA, 798 bp, Zea mays
  misc_feature (777)..(780): n is a, c, g, or t
  unsure (1)..(798): unsure at all n locations
cttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggtgagtgcatgatgaattcattgctgccatgaaaccaaaatgccatagcctaatagcttgcataagttattttttattattgttttttgatttgcactgtcttgtccaggggcttcaccaagttcagccgtgccgactacctgaagtacaagagtgagggtagaattgttcctgatggtgtcaacgcaaaggtacagctatcacatatcttgctacatttagatatatctctgaattagttttgggatagtaatgtaatttccattgatacgcatattttgaaatggagctattcttacaatgtttgctccgtcttctcttcggcagtatattaaccagttcataatctaattttaacttctcctgacttattacagctgctcggtaaccatggaagacttgagaagcgtgctcctgggaaggctttcctcgaggccgttgcttaagtccaatctacagttggaatgcgaatccagacgttttggtttagcctatcttattttgctttgtgcaacnnnnattttaagtgtatggggt

SEQ ID NO: 177 - DNA, 739 bp, Zea mays
  misc_feature (21)..(21): n is a, c, g, or t
  misc_feature (102)..(102): n is a, c, g, or t
  misc_feature (223)..(223): n is a, c, g, or t
  misc_feature (314)..(314): n is a, c, g, or t
  misc_feature (324)..(324): n is a, c, g, or t
  misc_feature (344)..(344): n is a, c, g, or t
  misc_feature (359)..(359): n is a, c, g, or t
  misc_feature (410)..(410): n is a, c, g, or t
  misc_feature (429)..(429): n is a, c, g, or t
  misc_feature (512)..(512): n is a, c, g, or t
  misc_feature (569)..(569): n is a, c, g, or t
  misc_feature (650)..(650): n is a, c, g, or t
  misc_feature (656)..(656): n is a, c, g, or t
  misc_feature (658)..(659): n is a, c, g, or t
  misc_feature (672)..(672): n is a, c, g, or t
  misc_feature (691)..(693): n is a, c, g, or t
  misc_feature (695)..(698): n is a, c, g, or t
  misc_feature (705)..(710): n is a, c, g, or t
  misc_feature (713)..(714): n is a, c, g, or t
  misc_feature (717)..(717): n is a, c, g, or t
  misc_feature (719)..(719): n is a, c, g, or t
  misc_feature (722)..(733): n is a, c, g, or t
  unsure (1)..(739): unsure at all n locations
cagcggcgagggtcgtgcccntggcatcggcactggcgggacgcggaaggctggtggcgcgtgcagcagttacagttgcgtgacattgctcttctgattttngtcagtcctttttttggtcgcaacacacattggctgtcctgaattattttctccttgtgtgttctcttgcgcaggcaaaggcggatgtgccatcgagcacgtccgacgggtaagaacgttntactccctgtctatggcatccatgtgacctgagcccgggacatacgcctgagatgctccacttttcatatctgagattttcatatgtttgntgattttttntcttcaatcactagtgcacncacatgccccaaccncaaaaggaaaatatgagtggactaagcagcaaagtgtggttttgagcatgnatttctaattcggctacantaataaatgaatactcactggttgtagatatctctaggttatgtaactatatgttgtaagattttattatggtacatgaggcngtcaccattgaattgattgcaagatgaaatttggcaccgaacttgctgttttgaatnggttaccaacctgaagtaattacagtagtctggaaaatgagtatttcatccttgtgcctttgcttgcttaaatgaatctanttggcnanntaaatctggaganataatattcagttttattnnngnnnntacttgnnnnnnctnnatngngcnnnnnnnnnnnncattta

SEQ ID NO: 178 - DNA, 1069 bp, Zea mays
  misc_feature (574)..(576): n is a, c, g, or t
  unsure (1)..(1069): unsure at all n locations
tgggtcgatgtgcttgcgctggttcatggcgatcaccaccttgtccacctcctccccgggcgaccgcgtcttctcgccggtcaggtactcggcgccgagctcctcgcgcacgaacctgtacagcgggtacgaacggcactcggtaatcctgttcggggtcgtgccactctccacagccgctcgtgcggcctccacctcgtccggtagcactgcgctgagctgcttctcgaactcagccaccttggccaggatggaggtctccataggtcgctcggtgttgctgtcaccattgatgagcgcatgctccatgagcaccgcgcggagcttctgcatcagtggatagctgggtctgcacgggtcttctgcgtacgtgaacaccgccacgcggtcaatagcgacgagcaggtcgtggtcgtcgatggccagggattttttggcgacatgcgacacgcacttcttaacagcggccttgatgctctcctcgagttggcgcaggtcgacggcctggcacagtgcgatcaggaaagtggaggacatgagcttcaggatggtgacggcctcggcggtcatcctnnnggagatgaggccgagagagttgacgctctggttgtgctgctccgctgtctgcacatggtttgtcacagggttggcgaggaactggagctcagagcagtaggacgccatggcgacctcagcgccattgaaaccgtagtccaagctcgggttgcgcccgccggacaggttggagggaaggccattgctgtagaagctactgacaagctcggagaactgcgcgaacatgagcttgccgatggcagcgacggccagacgagtattgtccatggacaccccgacgggagtgccctggaagttgccaccgtggagcgccttgcggcgggcgacgtcgatgattgggttgtcgttgacggagttgatctcccgctcgatcgacttggtagcgaagcggatgacctcgacctgcgggccgagccactgcggcgtcgtgcggatcgcgtacctgtcctgcttcatcttggtcagcgggtcaagctctccctgctccttggca

SEQ ID NO: 179 - DNA, 945 bp, Zea mays
  misc_feature (9)..(10): n is a, c, g, or t
  unsure (1)..(945): unsure at all n locations
tgcagtttnnttggtagacataggtgggcatgaaggtgattagttctttaagatttaagatgctaatctttatgttgagttatactgtgattaaaatgaagataaacatatagtagtgtggtctgtggtgtcaggatttgttttcataaaaattctttctgcatgcttaggtctgtttgttaaggtatatgctagtgtaaaagatggtgctctcagacatatccatgattcaaaattaaattagtggttgtgacgaagaattttgagctgggaaggcagtgtccacaggcaattgcttagagccctgccctgctgtgtatccttaaaattgacatgaatttaggacccttgtgatttatacatctatgccaaattgccaagtgctacttttctctatgtggaaggagatacatgcatggaaagttttgcgcgagccttgagtgtatcacagactatcacagctgagagggatatctgaaggatatatcatgattcatgattaagttaatgtgaagatctgactaaaattgtgcttgcagtaaacaaaacagttctggttgggaaccacagatctcttaggaacattgtattctgatctgactaaaattgtgcttgaaatgaacaaaacagttattggcaacctcagatgcttagatatattaggaacaaatgtattccgatctgactaaaaccgtgcttgcagtgagcaaaacagttcttgttgggaacctcagatctcttaggaacaaatgtgatctgatctgactaatattgtgcttgtagtgataaaaaagctcttgttgggaacatcagatatcttaatttttttgaaaaacgcaggagagctgcgcatatttatagataagatagaagaaagggtcttacaagagaggtacaggttagggacacctgcacccacacacacgcactatcaactgaaacaaa

SEQ ID NO: 180 - DNA, 817 bp, Zea mays
  misc_feature (812)..(812): n is a, c, g, or t
  unsure (1)..(817): unsure at all n locations
tgcacattcgtatgcctgcagctcgactctttaggatccccctgaacgtaccggccggccggccggcgccagccaactgatgttgcaaataaagaagcaagcatgcaactttgcggtttgcacacaacgtacggccgaacactggcgtctcgacctacttccagttgtaacggccgtcagatcgatggatggatcacatgcgccatgcacagcagcaacgaacgaaaatctcgaaccaaaacgcgcaccactctccaaggtccaagcacagtggagtccagagaggacatgtgacggcagtaataacatacatggaggccattgatggcacaacaacaactgctgctactgtcacgcacgtacagtacaggcacagtgaatggcaggcaacccacgccgcccgccacgcgcatgcatgcatgcatgttcacccagcagcacagcagacgattattactactgaggccaattgcatttacatctgcatttgcatttgcactgcattcatttctacacggccctacacgctgcaacctgtgacttgtcatatcgtgtccaccactacgcccctgcgacgtcattcgattgcggattcgcaattgcatgcccttgttgcattgcatatgctgatatgcatggtagctaggggtattgccgtccttgcaacataacatcaatgaactacgtgcagctagctagatcgatcggctcctactgaattttcgagagagcgagacagcaaaaaaaaacatataactgcagtcaaatttgggacgagcttggtggcaagcaggggtaccgagtccggaatncgtat

SEQ ID NO: 181 - DNA, 773 bp, Zea mays
  misc_feature (5)..(11): n is a, c, g, or t
  misc_feature (443)..(444): n is a, c, g, or t
  misc_feature (668)..(668): n is a, c, g, or t
  misc_feature (676)..(686): n is a, c, g, or t
  misc_feature (688)..(699): n is a, c, g, or t
  misc_feature (701)..(705): n is a, c, g, or t
  misc_feature (709)..(712): n is a, c, g, or t
  misc_feature (714)..(714): n is a, c, g, or t
  misc_feature (729)..(731): n is a, c, g, or t
  misc_feature (733)..(733): n is a, c, g, or t
  misc_feature (737)..(737): n is a, c, g, or t
  misc_feature (739)..(752): n is a, c, g, or t
  misc_feature (754)..(760): n is a, c, g, or t
  misc_feature (762)..(762): n is a, c, g, or t
  misc_feature (769)..(770): n is a, c, g, or t
  misc_feature (772)..(772): n is a, c, g, or t
  unsure (1)..(773): unsure at all n locations
gcctnnnnnnntctagagaaacataacacgtatgtatgggagagggagacgcctcaaaagttactaaaactaagttgtacagagcatctaacatgagatctttaagcttttgaaattgtgagaataacactggattttgctggtggtacttatggcacttagatatattctttactcctgtcgttacatgagtactgcttttgtctttgaaataatttccaaaatatataacaaaattagttttagccaatctctgttgcaagatttatcataatgcaatattaacttgattcactgtaagtttcttagctacattaaatttgtatcatctgtcaaacacatcaagtgctggaggtattcatttttcctttagacaaaacttgtcaaacacgttggttttgcttggacaaaatattgaggacatatatactttattttttttnncagtatcaacgaaggatttcctggaaaggcctctagcaggttctcaagtacagttatgcttgctggaaacaaatacgctcaacagttggtctcgtattgatcctggtacattccgggtccgtggagcaaactattttaggtaaatgtcattcttgcagtatcaggtcatacccatcatttatttatttgaaactcctggatgctttatgggagtgatcttagtnttgaatgnnnnnnnnnnngnnnnnnnnnnnngnnnnngctnnnnantatgctgcatattannnanttgnannnnnnnnnnnnnnannnnnnnanaaactcnntna

SEQ ID NO: 182 - DNA, 710 bp, Zea mays
  misc_feature (57)..(57): n is a, c, g, or t
  misc_feature (539)..(545): n is a, c, g, or t
  misc_feature (547)..(552): n is a, c, g, or t
  misc_feature (559)..(570): n is a, c, g, or t
  misc_feature (583)..(584): n is a, c, g, or t
  misc_feature (588)..(588): n is a, c, g, or t
  misc_feature (592)..(593): n is a, c, g, or t
  misc_feature (602)..(605): n is a, c, g, or t
  misc_feature (610)..(611): n is a, c, g, or t
  misc_feature (621)..(627): n is a, c, g, or t
  misc_feature (629)..(630): n is a, c, g, or t
  misc_feature (632)..(642): n is a, c, g, or t
  misc_feature (646)..(658): n is a, c, g, or t
  misc_feature (664)..(670): n is a, c, g, or t
  misc_feature (672)..(672): n is a, c, g, or t
  misc_feature (674)..(707): n is a, c, g, or t
  unsure (1)..(710): unsure at all n locations
cccctaccaaatcgagcacagctcagaagaggcaggggaggatcactctcctaccanccaaaagtcacctcgacactggacgtgatacaagagacacaaaacatgggccagaagacaccatgcatcagacagttctgagaacttattcaacagcaaaagtcatcttcggatttgttggcttcctcgttccaccatcctttttggcatcttttcctgtagaacagaccacgaatccaaccaaaagaagcaagcataaatcacatcagtagggtcataaaagaccttgttgttaaagcacacatcattcctaaacttccaaatggcccagagaatggctcctatgcctagaacaatcaaattcctcgtggttttcttataaatgttcatccagtcctcaaaaagagaatccaggttttgaggacatctcttcacatccagggcaacctgaagaactctccacacaaaagtggccactgggcaattgagaaaaaggtgattggtggattccaaaacaccacagaaacaacaatcagtcaacnnnnnnnannnnnntttttcnnnnnnnnnnnngagataatttttnntctncagnncaagccacnnnnaaacnnaaatttttgnnnnnnncnnannnnnnnnnnnaacnnnnnnnnnnnnntatgannnnnnntngnnnnnnnnnnnnnnnnnnnnnnnnnnnnnnnnnnatt

SEQ ID NO: 183 - DNA, 540 bp, Zea mays
  misc_feature (495)..(495): n is a, c, g, or t
  unsure (1)..(540): unsure at all n locations
aatgagatggttggcatgcaaagtattgtgttgaaactgataaaacattatcttatatctcaaagttctcaattgtttacaagaaggtaaagccctgtataattttatggcagataactgcaactcccatagaaaatccaatgccggaggttcccacatgagtagggtctgggaagagaaaaaccaaggcaagccttcccccgcagatgaggggaggctacaaatctcatcaacagacaaaactcatccatcggcgttggtagcgcccagatgccacatctgggtctggcactggacgcagcatccaccatccatttgtcctatcctttgatccacagttcatttaatttagtccacaaggaataacatatctacttctaattaatccaagtgaaatgggactatcttcgtgcattcctttacctccacatctgcctacctcttgcaccatcgctatttctctcgtgcggaattccaaggctgggttaaaaaaancacggaacacccctcacccctgtcggcctgttcttccactgacgc

SEQ ID NO: 184 - DNA, 515 bp, Zea mays
  misc_feature (9)..(9): n is a, c, g, or t
  misc_feature (124)..(124): n is a, c, g, or t
  misc_feature (200)..(213): n is a, c, g, or t
  misc_feature (352)..(352): n is a, c, g, or t
  misc_feature (354)..(354): n is a, c, g, or t
  misc_feature (415)..(416): n is a, c, g, or t
  unsure (1)..(515): unsure at all n locations
ctaccggcngtgaagcccgtggtcaaggtgttgcaccaatgatgcatgcgtctagcgtcgctggccatggcggccgcgctgctgatctagaccccatcaaggccaagatcgtctcccaccctanctaccaccgcctgctcgccgccttcttggactgccacaaggcacgcgcgccgatcgacgacccttcaactttagcnnnnnnnnnnnnnnacgtgttcgttcctgttgctgctatccttcctagattacatgtgttcatatatccctgtcgcatatgtgctcaccttactcaggtcggctgcccgccggaagcggccgaggagatcgcggcggtggcgcgggagcgcgngncgtggcagcgtgcagccgcgggcgacgttgcgcacacaaggccggacccggagctcgaccnnttcatggtggagtaccgtacgaaacacatgcatgcttgcacatgacacaccctgcagcctctcatccctgggatgatcacgcatatatatggcctcata

SEQ ID NO: 185 - DNA, 764 bp, Zea mays
  misc_feature (724)..(726): n is a, c, g, or t
  unsure (1)..(764): unsure at all n locations
ctacaaaacaagtaataagttctctcttctaaaatgccgcccttgctattcttttctagtttcggaaaattttcaggtctcccgagcttcctgaactcaggattcacctgtatgctatttcgaaatttcagaatacttcatcccatgaagggcagatacggttcctagtatatactttggagaatgcaatcttcagcctgcctgaaggccaagaaaaaatggtatggctgattgatttcacaggatggacagtgtctcatgcttcgccaataaagacttgtagagaaactgcaaatatactgcaaaatcattttcctgaaaggctggccattggatttctatttaatccccccaaagtatttgaagctttttataagttaagtgctctcgacctttgcgcatctatctgattttaattttaaaaaaactgagaaaccaacatgtagtgttgatacagacaaaaacattgcattttccattctttaccaacttaagtttttcaaattctttcaggtcatcaagattttcctcgatccaaaatcagtcgagaaggtgaacttcgtgtaccagaaggatgaggagagcatgaaggtcatgtacaaatacatcgatccggaagtccttcctgtagagtttggggggaagagcaatgtggtgtacaaccacgaggagtactccgagttaatgagacaagatgacatcaaaacagcaagcttttgggcannngatgcgaaaactaaccatgctaaccctgccatcaatgg

SEQ ID NO: 186 - DNA, 630 bp, Zea mays
  misc_feature (529)..(529): n is a, c, g, or t
  misc_feature (537)..(539): n is a, c, g, or t
  misc_feature (561)..(564): n is a, c, g, or t
  misc_feature (603)..(605): n is a, c, g, or t
  misc_feature (607)..(607): n is a, c, g, or t
  misc_feature (609)..(609): n is a, c, g, or t
  misc_feature (618)..(619): n is a, c, g, or t
  misc_feature (622)..(622): n is a, c, g, or t
  unsure (1)..(630): unsure at all n locations
gtatccttcattaccatgtggattcacaactagtatgttggtacttatatttagttttgtcaagtattgatgaaatcatgtcaatttatagagaaccattttagcatgtagttgactagatagatagcaactttttaataaaatgcaatgtatacatgatgaaaacaacattacttaactttttgtgagacattgtccattcaagtcggctctaaaaatgtcttctcatttaaacttgagaccgtgattatatctatcaccttcgcaggttcaccactgccttgggtgggctttctccaaacgagattatgaaacgaaccactagtaggcttgagaccattcactcagagggtgttcatgtatgtacatactatataacgtgtcattcattgcttataaatttgatatttctttgaggggagaaaaaactcttttcttgcagagattatcggagatgtgctgccttgcagtttctcagcttctggtgctaggaaagtcagtaatatcttctgccaataaatcaaagaangaggacgnnnaaaatgatgttaagattgattnnnncgaagatgccatttcaaaagccaaaataatcagatggannncncnatccatctnngtngatatgga

SEQ ID NO: 187 - DNA, 733 bp, Zea mays
cccctgcaatatgcaacaattctgtcaatagaataaggctgcatacaattctgtcgtcgaacactttctatgatctcctctctgagtctgggttgctttgtgtggattgtgaaaagcaagtcattttgcttttgcttgagcttgcacttgagattgttctcccgctcactagcaacctgcaggtagagagcatttcttctgaaacctcagaggatgaatcgagcttcttgtctgcaacatcatttggactttcaaggcttgacaaggagcgtgtgtacaatgctagtgcagttgttgtgctgatccgttcgttgctggtatttacacctaaagttcaacttgagttgctgagattcattgagaagctagcaattgctggtcccttcaaccaggagaatctaacttctgttggtatgggcaaaagatattcttgttatcctttttcttttgactcattttgacaaggacacttacgtttttgctactcttttatgacataggatgtgttggccttctacttgaaacaatcaacccatttttggagggttcttctcctattcttaatcatgccttgaaaattgttgaactgctaggtgcttacaggtttgtcatatctcataaaattccatgcgcttcattgcaacaattttgttttgttgtttcacagtacatggttactcttctctttgtccaggctgtcttcatctgagctaaggcttcttgtgagatatat

SEQ ID NO: 188 - DNA, 255 bp, Zea mays
gcatgtcgtcaacgccactagctcactgcccttcttcccttgtatcagcacatgtaggtaacgtgataaaccaaacataaagtacacctgcgttgccgtgtgcataaacagcacatgtttaaatctatgctggaattcatataccaggcaaaaaatgtacagtaaaaactttacagtgataaaaggtggcacatcatgtttccagatgattccagcagaaaattttaggcaggccttaacgcaacacatttcggg

SEQ ID NO: 189 - DNA, 694 bp, Zea mays
  misc_feature (72)..(72): n is a, c, g, or t
  misc_feature (244)..(244): n is a, c, g, or t
  misc_feature (285)..(285): n is a, c, g, or t
  misc_feature (309)..(309): n is a, c, g, or t
  misc_feature (330)..(330): n is a, c, g, or t
  misc_feature (338)..(338): n is a, c, g, or t
  misc_feature (410)..(410): n is a, c, g, or t
  misc_feature (427)..(427): n is a, c, g, or t
  misc_feature (453)..(453): n is a, c, g, or t
  misc_feature (472)..(472): n is a, c, g, or t
  misc_feature (583)..(585): n is a, c, g, or t
  misc_feature (610)..(615): n is a, c, g, or t
  misc_feature (622)..(624): n is a, c, g, or t
  misc_feature (634)..(635): n is a, c, g, or t
  misc_feature (637)..(638): n is a, c, g, or t
  misc_feature (651)..(691): n is a, c, g, or t
  misc_feature (693)..(693): n is a, c, g, or t
  unsure (1)..(694): unsure at all n locations
atgagcactttagaagtcaacccttggattgaagaaattgacctccacggaacacctttgcatgttgctggnaaaacggaccaaatttatgagaagctctgtcaaaatgagagtcttgttctgccaaacgattttcttgatttgccactaagtgctcctacttgctgccgggtttttctatgtggtcaggaatcagcaggtatcatcagcaattcagcattatccattattaccctcattatcngctgtaagcagaaatgtagtagttagatcagtaatcagtanacaatgttcatcttgttttctctnttaacttggagagttgctaantaaacaangtgaaacctcattttactctagaatcttaaatcacattcgcttgcaatactagccactaaaataatacctcngacatgcaaagacgggnaaaaaaacctttattttcattttttncttgttgcaactgataacncaatttgtggtggccatgcaggtaaaagcacgttacataactccataaatcagagcatgaacccattgaagtcgcctcacataaatataacaagtactttgatgaaaccgnnnttgcaaatggagtacaccaatgagnnnnnnagtagtnnnttctttgatnncnncacaaaaatgacnnnnnnnnnnnnnnnnnnnnnnnnnnnnnnnnnnnnnnnnnang

SEQ ID NO: 190 - DNA, 351 bp, Zea mays
  misc_feature (349)..(349): n is a, c, g, or t
  unsure (1)..(351): unsure at all n locations
tgcctccccctcaactcccttacagcctctcaaagacaagctacgaagagtggcattcctctctaaactagtaaagattttgacaacatcatttggcttcaaacttgcatcattgcatattgccagctgaattaggctctggtttgtctccaacatctgcaagatagcaggtacaccaaacttgcttatattcgctcgctctcctccaaaactcaaaaccttcaatgtggtattggcttgtctctgaagtggagaaaaggtgctaagagggcatagcaaatgctccacccctactccaccaaatctatttccatccaaagtcaagttctctaaatagctgttcttaaanag

SEQ ID NO: 191 - DNA, 535 bp, Zea mays
  misc_feature (11)..(19): n is a, c, g, or t
  misc_feature (29)..(37): n is a, c, g, or t
  misc_feature (47)..(53): n is a, c, g, or t
  misc_feature (71)..(71): n is a, c, g, or t
  misc_feature (132)..(133): n is a, c, g, or t
  misc_feature (397)..(397): n is a, c, g, or t
  misc_feature (426)..(426): n is a, c, g, or t
  misc_feature (465)..(472): n is a, c, g, or t
  misc_feature (531)..(531): n is a, c, g, or t
  unsure (1)..(535): unsure at all n locations
atggacaacannnnnnnnnaaaccctgcnnnnnnnnngtgagtagcnnnnnnnctttagaaatacacattngacatattcctccactacgcatgtttacatatcctactgcaaattctctctctctctctcnngatgagcaggggctggcgtttcttcatgattaaactctggaaccacagccttcttgacgcccgcgccatgaatgcttgcaacacaatccttcaaggctaccaagacggaagtgcggaccccaagtaaatctacaatccagagaaatcgttggccagcgtgtgtaagatctgccggttccggcggttatttctgaaccccaaaacagctatgtgaagaactggaatggggccatagcggcatttgttttaaggtttagggttacnccatttttccaagggaggaaactaatttnccttggaaaaatgaaaatccattgggaaaaatgagtttnnnnnnnntagccattaaaagggtagcttcctcccacctagggggaaaaaaactaggagggaaaagntgga

SEQ ID NO: 192 - DNA, 1609 bp, Zea mays
  misc_feature (113)..(113): n is a, c, g, or t
  misc_feature (145)..(179): n is a, c, g, or t
  misc_feature (215)..(215): n is a, c, g, or t
  misc_feature (270)..(270): n is a, c, g, or t
  misc_feature (285)..(285): n is a, c, g, or t
  misc_feature (303)..(303): n is a, c, g, or t
  misc_feature (330)..(330): n is a, c, g, or t
  misc_feature (374)..(374): n is a, c, g, or t
  misc_feature (397)..(397): n is a, c, g, or t
  misc_feature (430)..(430): n is a, c, g, or t
  misc_feature (478)..(478): n is a, c, g, or t
  misc_feature (559)..(559): n is a, c, g, or t
  misc_feature (874)..(877): n is a, c, g, or t
  misc_feature (890)..(891): n is a, c, g, or t
  misc_feature (907)..(909): n is a, c, g, or t
  misc_feature (918)..(931): n is a, c, g, or t
  misc_feature (939)..(943): n is a, c, g, or t
  misc_feature (947)..(956): n is a, c, g, or t
  misc_feature (958)..(959): n is a, c, g, or t
  misc_feature (965)..(972): n is a, c, g, or t
  misc_feature (976)..(978): n is a, c, g, or t
  misc_feature (980)..(980): n is a, c, g, or t
  misc_feature (990)..(990): n is a, c, g, or t
  misc_feature (992)..(992): n is a, c, g, or t
  misc_feature (994)..(996): n is a, c, g, or t
  misc_feature (999)..(1001): n is a, c, g, or t
  misc_feature (1016)..(1018): n is a, c, g, or t
  misc_feature (1026)..(1027): n is a, c, g, or t
  misc_feature (1029)..(1029): n is a, c, g, or t
  misc_feature (1032)..(1046): n is a, c, g, or t
  misc_feature (1050)..(1166): n is a, c, g, or t
  misc_feature (1171)..(1176): n is a, c, g, or t
  misc_feature (1180)..(1193): n is a, c, g, or t
  misc_feature (1195)..(1240): n is a, c, g, or t
  misc_feature (1245)..(1272): n is a, c, g, or t
  misc_feature (1274)..(1296): n is a, c, g, or t
  misc_feature (1301)..(1305): n is a, c, g, or t
  misc_feature (1313)..(1315): n is a, c, g, or t
  misc_feature (1317)..(1317): n is a, c, g, or t
  misc_feature (1327)..(1333): n is a, c, g, or t
  misc_feature (1338)..(1340): n is a, c, g, or t
  misc_feature (1344)..(1348): n is a, c, g, or t
  misc_feature (1352)..(1371): n is a, c, g, or t
  misc_feature (1373)..(1393): n is a, c, g, or t
  misc_feature (1407)..(1453): n is a, c, g, or t
  misc_feature (1455)..(1461): n is a, c, g, or t
  misc_feature (1463)..(1468): n is a, c, g, or t
  misc_feature (1476)..(1480): n is a, c, g, or t
  misc_feature (1486)..(1488): n is a, c, g, or t
  misc_feature (1497)..(1503): n is a, c, g, or t
  misc_feature (1505)..(1505): n is a, c, g, or t
  misc_feature (1507)..(1513): n is a, c, g, or t
  misc_feature (1516)..(1523): n is a, c, g, or t
  misc_feature (1525)..(1525): n is a, c, g, or t
  misc_feature (1533)..(1537): n is a, c, g, or t
  misc_feature (1539)..(1546): n is a, c, g, or t
  misc_feature (1548)..(1548): n is a, c, g, or t
  misc_feature (1550)..(1556): n is a, c, g, or t
  misc_feature (1571)..(1580): n is a, c, g, or t
  misc_feature (1582)..(1582): n is a, c, g, or t
  misc_feature (1584)..(1585): n is a, c, g, or t
  misc_feature (1590)..(1601): n is a, c, g, or t
  misc_feature (1603)..(1605): n is a, c, g, or t
  unsure (1)..(1609): unsure at all n locations
gtcggtatctgcccgttgttggcgaagtcgatcttgttcagcctcatgcagcacaggacatgctctggcaactcctcagccttatgtgcctgtaaccagtatcagaccatggnttaagctacagacactcggtcaaggggtcacnnnnnnnnnnnnnnnnnnnnnnnnnnnnnnnnnnngaaacaaatcaagcggtcacttttcagccagcagcngaagaaaactgtgtgtacctggatagttagaccaagatcaagaacgccatgcttnagccgctcctggaangtctcgagccctttccgngatatgaagctgaaccgatggacatcnagatcgatctcaaagtagtttgaaccctacattattatcaatgnaaaagacacgcattttttttatntttgtcagagttggaaacacggttcactatttnagcacctgtttgtctataaataaactagcgaggaaattaatgcagtcntcggttaccttgtagaatttgtgttgtgggcgagatagcacaggcttcatattgtaggtctgcacaagcttcctctctgcngtgctcagttgcaggtcctcagggttcgccaaaccagccaggattttcagcctctcggtgtagggcacaatgctgtctactgggaaacccttcaccttttccgtttcctcgttcatgagcctctgcatcactggtccgtcagaaagttttcctaatgaggtgctttgtctgtgtactcagataaatctacctttatgctgtcctgcaactgaggagaaatctccttgtcaaaactgtcagataacttgaaatacagaactaggcttatcccatcgccgtcgttatcgccaaacactgtagcagggtaggtgggcnnnngcacaaacaagtnnaaacttgtcaggctannngccagaaannnnnnnnnnnnnntcagtaannnnngagnnnnnnnnnngnnccgttnnnnnnnnactnnntnacctgaatgntnannntgnnnagggtaggaaaggcnnngtgtgtcnngngannnnnnnnnnnnnnntgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcannnnnnatcnnnnnnnnnnnnnngnnnnnnnnnnnnnnnnnnnnnnnnnnnnnnnnnnnnnnnnnnnnnntctcnnnnnnnnnnnnnnnnnnnnnnnnnnnnannnnnnnnnnnnnnnnnnnnnnnagctnnnnncccgtcgnnnancacggcaccnnnnnnnctgcnnntggnnnnnacannnnnnnnnnnnnnnnnnnngnnnnnnnnnnnnnnnnnnnnnaagtaataatccannnnnnnnnnnnnnnnnnnnnnnnnnnnnnnnnnnnnnnnnnnnnnngnnnnnnncnnnnnncggtcatnnnnncgcccnnntatgacctnnnnnnnancnnnnnnntgnnnnnnnncnttttcttnnnnngnnnnnnnngntnnnnnnnggcaccagcgatcgnnnnnnnnnngncnntgttnnnnnnnnnnnncnnnggga

SEQ ID NO: 193 - DNA, 655 bp, Zea mays
  misc_feature (66)..(66): n is a, c, g, or t
  misc_feature (68)..(68): n is a, c, g, or t
  misc_feature (309)..(309): n is a, c, g, or t
  misc_feature (326)..(329): n is a, c, g, or t
  misc_feature (331)..(333): n is a, c, g, or t
  misc_feature (555)..(561): n is a, c, g, or t
  misc_feature (564)..(568): n is a, c, g, or t
  misc_feature (570)..(576): n is a, c, g, or t
  misc_feature (578)..(579): n is a, c, g, or t
  misc_feature (589)..(590): n is a, c, g, or t
  misc_feature (593)..(608): n is a, c, g, or t
  misc_feature (610)..(611): n is a, c, g, or t
  misc_feature (613)..(653): n is a, c, g, or t
  unsure (1)..(655): unsure at all n locations
atatctgttattacttaatatcttagttaccatattttttttgaggggaatagttaccatatctgncngctatgacacagtctgcggtaaaagcatatgtgttcactgtagattttgggagggaaattggcttacctgtactctcatacattgttgccttgctggcaacatggttaaccaatgacataacatgcaaactgtatctttttactatttaccttaaccatgccagctttttatttggttctaggcatctttttattcttccttgctgtaatctactggattgtagcatgaacaccttcatgngttttagcttatgtttnnnntnnncaaccagtggtggcctgtgatatgtctactgtcaaatctgggacatactatgttgcaggcttctctagtccgtatttggctccaatctgtactagaacatatactcatttatctggtctactggtttaccaaatcatattacagaatagttgtgtgtattttgtgttccagcactttgttcactgaaatttgaaatcccagtttcttactcacattaattannnnnnnttnnnnncnnnnnnnanngggcggaaanngtnnnnnnnnnnnnnnnntnnannnnnnnnnnnnnnnnnnnnnnnnnnnnnnnnnnnnnnnnnat

SEQ ID NO: 194 - DNA, 582 bp, Zea mays
  misc_feature (159)..(159): n is a, c, g, or t
  misc_feature (541)..(542): n is a, c, g, or t
  misc_feature (551)..(555): n is a, c, g, or t
  misc_feature (558)..(565): n is a, c, g, or t
  misc_feature (567)..(579): n is a, c, g, or t
  unsure (1)..(582): unsure at all n locations
ctgcagcatctcaatttctccccgtatgtcttcatagccttcttcctgaatgccagagatacatgcttatattttaaagacaaaaatgcaaggactcagaaatcagaaagcaaccacatttatgagattctcccacaattaagcccatgcaaacaaaantgctcacaacaaaagcaatatggttgccaaatatgaaatatgtcttgggtagccttccggaatattcacagaactttgtaataagaagctagaaactaaccccttctgttaatgagatgatcttgacagccacaagctcctgcgttctgagatcccttgctttgtacactgcaccatatgaacctttccctgcatttccaattgaatttgcattgcgcaaaatagctcaaaatttcaggcattatacaaaaagacatataaagaactaatgaaataataattccagagcaagagtcgcaccaagctcatggagcagctcgtacttggtggaaggatcctccctggtaacactgtctggcaccgagctgaccgatggcttccnncttgaatgnnnnngcnnnnnnnncnnnnnnnnnnnnnatg

SEQ ID NO: 195 - DNA, 674 bp, Zea mays
  misc_feature (542)..(542): n is a, c, g, or t
  misc_feature (594)..(594): n is a, c, g, or t
  misc_feature (606)..(606): n is a, c, g, or t
  misc_feature (616)..(617): n is a, c, g, or t
  misc_feature (629)..(630): n is a, c, g, or t
  misc_feature (633)..(634): n is a, c, g, or t
  misc_feature (641)..(642): n is a, c, g, or t
  misc_feature (645)..(645): n is a, c, g, or t
  misc_feature (651)..(658): n is a, c, g, or t
  misc_feature (663)..(665): n is a, c, g, or t
  misc_feature (667)..(668): n is a, c, g, or t
  misc_feature (671)..(671): n is a, c, g, or t
  unsure (1)..(674): unsure at all n locations
ggttcggattggctgccgttattgcttatagctaagtccagtattgcctggttatgaaattctccgtgctttgatgatgttggtgatttggtcatttgatgtttactaggagaatgctttccacgaaaaaagtgctatgctgtgcgtgtagttagttatgactagtgaaaagcagggggtatttcttcttgaaggtaggggcaagtcgaagtgtcattgtcgaactaacgagagatgaacttatggtgaaaacgagctatgagaaacctatactagaacatgaaacttttggattgtattttcaggtttgaatgataatcagttatgtttgtatgctttgttagttttcagatcatgaacttgttcgtgaacatgagttgtacctatctacctgactacctgagtagtgttctgatttttcaacttggtaatggaatagctgaagaccacatcgtgattgaatcctatgggtaggatgggtaggttaggagctggtcactggtcagggaatctcaatgttgagccagtagcaagctttggtnggtttcaaaaaggaaatggcaagttcctggttgtcatgtgaatgatgaacangtagcaagattnatgggttaannaaaaataaaatnnatnntagctgnntgntgatgnnnnnnnntactnnncnntgntct

SEQ ID NO: 196 - DNA, 924 bp, Zea mays
  misc_feature (421)..(435): n is a, c, g, or t
  misc_feature (481)..(481): n is a, c, g, or t
  misc_feature (488)..(488): n is a, c, g, or t
  misc_feature (561)..(561): n is a, c, g, or t
  misc_feature (601)..(601): n is a, c, g, or t
  misc_feature (603)..(603): n is a, c, g, or t
  misc_feature (651)..(651): n is a, c, g, or t
  misc_feature (653)..(653): n is a, c, g, or t
  misc_feature (736)..(736): n is a, c, g, or t
  misc_feature (741)..(741): n is a, c, g, or t
  misc_feature (885)..(885): n is a, c, g, or t
  misc_feature (888)..(890): n is a, c, g, or t
  misc_feature (897)..(906): n is a, c, g, or t
  misc_feature (908)..(923): n is a, c, g, or t
  unsure (1)..(924): unsure at all n locations
tcacagggttcacatcaaaacacagatcccaattatagaaggatgaataatgaattcacacaatacatggagtctatttacgttccatgtcttagtttggcactggatcccttaatggtgaactataattaagtaagatcttggacagcttcttcacttcctgaacagatctactaccaggtatgaggtatggagcagatcgcgacaggttgaacagacagtggagctagttaaataagcctgagatggcagctccatgtatagttgcaggaagctaagcctacttaattggattcatagctgaggcaagctcgaaagatcgagctgagctgaattggagtgcagtgggaccaaaactagaagccaccgacgctgcactggagccaccgacactgacagtgtcagcgcgcagcggaagcannnnnnnnnnnnnnntcatcacagctcgccgagctccgttgcatcagacgcaacggcgatngggcggnggatctaaccagcttcgaacttcgcgcgcaaacgagagaggcgtagggagacggacgaggagaagcgaagaanccgaagtgccgaacctgttgcagtcggtgcggagaggagnancgcggccgcgagcagcgcggcggcacagcacgcgacggatctgccgcncnccgccattcttccttgccacccgccgcctaaccgacacacgcggtctcccaccgacagatagatacagagccgcgcccgcccncccgnccgtccgtctacccgacgatcttgctccgtagtgcggcgactacggttgcggccgaggggaggaatggggggcggtggggaggagggcggagatctggggaggtggggagtgggacttaaagcatgtgcggcaggcagcggccncgnnnccctccnnnnnnnnnncnnnnnnnnnnnnnnnng

SEQ ID NO: 197 - DNA, 632 bp, Zea mays
ttgttcctgttataattaacttattttctttcttcattttcatacaatccatgctaatttcctaatcatttccagaaccgtggcatacactaaccatacagtgcttcctgaagctctagagaagtggagcttggacataatgcagaaacttttacctcgacatgttgagataatagaaacaattgatgaagaggtattagatgtgcagaaagtgcttatgcaaatttacttcttgctctatgagttaacgtacacttttctctatacttgattgaaacagctgataaacaacatagtctcaaagtatggaaccacagatactgaactgttgaaaaagaagctgaaagagatgaggattctggataatgttgaccttccagcttccatttcccaactatttgttaaacccaaagacaaaaaggaatctcctgctaaatcaaagcaaaagttacttgttaaatctttggagactattgttgatgttgaggagaaaactgagttggaagaggaggcggaggttctatcagagatagaggaggaaaaacttgaatctgaagaagtagaggcagaagaagagagttctgaggatgagttagatccatttgtaaagtctgatcctaagttaccaagag

SEQ ID NO: 198 - DNA, 677 bp, Zea mays
  misc_feature (240)..(240): n is a, c, g, or t
  misc_feature (410)..(410): n is a, c, g, or t
  misc_feature (521)..(528): n is a, c, g, or t
  misc_feature (530)..(530): n is a, c, g, or t
  misc_feature (532)..(536): n is a, c, g, or t
  misc_feature (539)..(548): n is a, c, g, or t
  misc_feature (550)..(550): n is a, c, g, or t
  misc_feature (565)..(566): n is a, c, g, or t
  misc_feature (568)..(570): n is a, c, g, or t
  misc_feature (572)..(572): n is a, c, g, or t
  misc_feature (586)..(606): n is a, c, g, or t
  misc_feature (608)..(676): n is a, c, g, or t
  unsure (1)..(677): unsure at all n locations
gagacaagacaatgttttcgttcaataagcttcaagctggaggaagcgacgctggagctctttgccaaatttggatggaaatttaataatagactttgtcctcttgattattgtttgccctttcaagcaagccggtaacccgattttggaatatgtggacgctatgtgcggaaacgcagaggcgggaaccttgtcccattgtctaaaaaatgatcagtaggaggcaactcatgctggtcnctagaaaaatcagtaacagaaccaaaattacatatttattttgctctaaagtatggtaattggtaaattggtaatataacaagctatcagtttagtttcctcattcaaagatgtacaaagagctcaattgaagtgtgatctaagaagttctactgaaagattgtaacagnttttctattcttgaaggccatgttttgtgaattcgaacgtgtgttcacctgaacagagctactgcatcttcagcaatcccaaacaaaaacacacaaaaaaatgtttcatgnnnnnnnngntnnnnnatnnnnnnnnnncncatcggcgctgatcnncnnngntactttatcaagtnnnnnnnnnnnnnnnnnnnnnannnnnnnnnnnnnnnnnnnnnnnnnnnnnnnnnnnnnnnnnnnnnnnnnnnnnnnnnnnnnnnnnnnnna

SEQ ID NO: 199 - DNA, 670 bp, Zea mays
  misc_feature (479)..(479): n is a, c, g, or t
  misc_feature (575)..(575): n is a, c, g, or t
  misc_feature (583)..(583): n is a, c, g, or t
  misc_feature (593)..(593): n is a, c, g, or t
  misc_feature (598)..(598): n is a, c, g, or t
  misc_feature (639)..(639): n is a, c, g, or t
  misc_feature (655)..(655): n is a, c, g, or t
  misc_feature (657)..(657): n is a, c, g, or t
  unsure (1)..(670): unsure at all n locations
cagaccattcttttccaagtgcatgacccatcatttcatggggcagtggtagggcagtagcgcaactttccgacaaaccaatatttcctgtctctctcaatttcacacttgcatgtagttgtagattatgcttaccatgaccaggtaacttcagagcaagatcaagaatctcttctgttctttgaagacaaagcttcatacggtcaccagatgacaatgaagtatgtattgtcccatgggaagaatcataaagctgctgcatggaacgatcatgaggtatggactgagaaatgtattgttgctgttgctcctgttgcctgagctgtagcatgttgttcaatagagaggattgaggttcagggactccaggaatcaggggttgcaagtgtagctctgatagcagatactgttgttggttgatgtttaactgaggatcatgatatattccaccgagaaacttttctggctgtgtgatttgngagttcaaacaagctaaagttggttgattctgtgttaaaacgtaatgctgttgagcatcaatacctatttgctgagaattatgcagattttggtgnacatttantatctcttgngtaanatctataccacacataccagcatgcagatttccagagtcancattatttgaccgaangncaatccagaattg

SEQ ID NO: 200 - DNA, 667 bp, Zea mays
  misc_feature (125)..(125): n is a, c, g, or t
  misc_feature (177)..(177): n is a, c, g, or t
  misc_feature (496)..(496): n is a, c, g, or t
  misc_feature (596)..(596): n is a, c, g, or t
  misc_feature (598)..(600): n is a, c, g, or t
  misc_feature (613)..(613): n is a, c, g, or t
  misc_feature (627)..(627): n is a, c, g, or t
  misc_feature (637)..(638): n is a, c, g, or t
  misc_feature (640)..(641): n is a, c, g, or t
  misc_feature (643)..(643): n is a, c, g, or t
  misc_feature (662)..(662): n is a, c, g, or t
  misc_feature (665)..(666): n is a, c, g, or t
  unsure (1)..(667): unsure at all n locations
tctactggtgttcaattggtttctaacatatgaaaagatgtgccagccaaaattctgttttgatctgttagatgatgtatacatgcccatgtgatattggagttacatatggctaatataaaaangacacctgaaccttaggcaagatgaaaggcagctttcttcttgtttccattnattgttcctgttttgactcatttatgctgaaattgctgatgctatttacttcttttctgaccataaggatgggggttgcaacttctttgagtggtgcgatgctccatctcccgcccctgccaatgcacgaaataacatggttgtacactcagagacatcagcaacagatatgctttgcccatgcagtgctggaacttgcttaattctcaccacaaagacagggaaaaatgttgggaggcaattcttttgctgcccattaaatcaggtaaactcaggattcaccaatgttacctgaattcatgacattttgccgtaccanatagcggcctatactggtttgtttttctggaagaacttggcccctttttatctgacacaacttgtttaattataacattgaacatctgcaaccctactcntnnntgaatttgagtantcaacatttgtggnattttgaacnngnntnattataacattgaacatcngcnnc

SEQ ID NO: 201 - DNA, 429 bp, Zea mays
ttcaaaacgttgttttcatatgctcataaagttacacgaaattatctgccataccattattcctttcctattaagccgatgtagctccctccccgttcaaggcatccacgccgactgcaatatcgtggccacacgttttcatcttcgttgcacgcgtggcaagtccggcatcctaccttcctagggaaaaaaaagctgaaaaatccaactccgcagtactgtcttacttatcttcgctacactacatctggatgctgcttcttatcttcgctacacaagcatgtctccaactccgcagtgctgtcttggaaaaaaggggtctgtaccttctctcaccccgacggcgcttcctacttcctagggcgaccgcggcggcgccacatgcttcgccagcgtcggtcttcccgtcgtcatttctacttcttctgc

SEQ ID NO: 202 - DNA, 1230 bp, Zea mays
  misc_feature (6)..(14): n is a, c, g, or t
  misc_feature (179)..(179): n is a, c, g, or t
  misc_feature (183)..(184): n is a, c, g, or t
  misc_feature (188)..(188): n is a, c, g, or t
  misc_feature (245)..(246): n is a, c, g, or t
  misc_feature (255)..(255): n is a, c, g, or t
  misc_feature (296)..(297): n is a, c, g, or t
  misc_feature (318)..(318): n is a, c, g, or t
  misc_feature (338)..(338): n is a, c, g, or t
  misc_feature (342)..(342): n is a, c, g, or t
  misc_feature (350)..(350): n is a, c, g, or t
  misc_feature (364)..(364): n is a, c, g, or t
  misc_feature (412)..(412): n is a, c, g, or t
  misc_feature (630)..(634): n is a, c, g, or t
  misc_feature (638)..(638): n is a, c, g, or t
  misc_feature (640)..(640): n is a, c, g, or t
  misc_feature (642)..(642): n is a, c, g, or t
  misc_feature (655)..(655): n is a, c, g, or t
  misc_feature (661)..(665): n is a, c, g, or t
  misc_feature (670)..(677): n is a, c, g, or t
  misc_feature (681)..(682): n is a, c, g, or t
  misc_feature (684)..(685): n is a, c, g, or t
  misc_feature (689)..(689): n is a, c, g, or t
  misc_feature (697)..(697): n is a, c, g, or t
  misc_feature (711)..(716): n is a, c, g, or t
  misc_feature (719)..(719): n is a, c, g, or t
  misc_feature (723)..(723): n is a, c, g, or t
  misc_feature (733)..(735): n is a, c, g, or t
  misc_feature (737)..(737): n is a, c, g, or t
  misc_feature (739)..(739): n is a, c, g, or t
  misc_feature (744)..(749): n is a, c, g, or t
  misc_feature (757)..(757): n is a, c, g, or t
  misc_feature (759)..(836): n is a, c, g, or t
  misc_feature (840)..(841): n is a, c, g, or t
  misc_feature (847)..(862): n is a, c, g, or t
  misc_feature (866)..(868): n is a, c, g, or t
  misc_feature (870)..(870): n is a, c, g, or t
  misc_feature (876)..(876): n is a, c, g, or t
  misc_feature (878)..(879): n is a, c, g, or t
  misc_feature (889)..(893): n is a, c, g, or t
  misc_feature (897)..(898): n is a, c, g, or t
  misc_feature (922)..(923): n is a, c, g, or t
  misc_feature (934)..(936): n is a, c, g, or t
  misc_feature (943)..(944): n is a, c, g, or t
  misc_feature (952)..(953): n is a, c, g, or t
  misc_feature (1037)..(1037): n is a, c, g, or t
  misc_feature (1181)..(1181): n is a, c, g, or t
  misc_feature (1186)..(1186): n is a, c, g, or t
  unsure (1)..(1230): unsure at all n locations
gcgggnnnnnnnnncaggggcatgccgccgttggccccggcggcggtagagaatcctgatgatgctgcagagtggtgcaacggcacgtgaggggagccctgcgcttgccatgcccatgaggggaatggctgggcgcccagctcaggccttcgctccaccggcctttcctggacctgcangatnncgcngcagcacgagcatgagctttgtttgtcaggttttgaccacagtgaacgtttccaccnntaagtcgtncacaggaaacagagcgaacaaacaaccaagattggatatcnncgagcatgattaatctttcangattctgttttaattaattnattnattttaangtatgtgcagcacnatgaagacttgatgctagctctatttcccgtaaaaattcagagaatcntcaggactacagctgcagcacgtgatccctgatcagcgtactaaaagatacatcccatgttatgtcaagaaactgcgacccaacaaccgcgactgcggtgtttcaaaagatggaaagtggcagaacggcctggtcgaaacaccaaccagtccacacaccaaacagtacctgccattatagtaaggagtaccattgccccccaccccccccaaaaaaannnnnaaangnantgctgtatagtanttttcnnnnnagcannnnnnnncatnngnnattnctaaacangctaacagtaacannnnnntanggantcaatctacnnntnantgtcnnnnnngctgctcncnnnnnnnnnnnnnnnnnnnnnnnnnnnnnnnnnnnnnnnnnnnnnnnnnnnnnnnnnnnnnnnnnnnnnnnnnnnnnnatgnncagctnnnnnnnnnnnnnnnnacgnnngnttggantnnctgatggagnnnnnagtnncagacatttgcatgtgtaagtgtnncaaagggatcnnngcgatanntggtggtnnggaaagaagccatgacaagctgacgagtacaagcgctgatggtgagatgacactgctgggttttggtgatacccgggccaaggngatgatgagctcattggctacagcagcagcaggtgaaaggagcaaacactgtgagatcaataatagttgtaggacctggaccacgaattaatatcgatctcccccaaccatatgccaatcaaatagtcctatgaatctttgtangctangagttactagtaggaactagtatcagaggtccaagattctacaa

SEQ ID NO: 203 - DNA, 642 bp, Zea mays
  misc_feature (239)..(239): n is a, c, g, or t
  misc_feature (280)..(280): n is a, c, g, or t
  misc_feature (312)..(312): n is a, c, g, or t
  misc_feature (359)..(359): n is a, c, g, or t
  misc_feature (364)..(407): n is a, c, g, or t
  misc_feature (434)..(434): n is a, c, g, or t
  misc_feature (551)..(551): n is a, c, g, or t
  unsure (1)..(642): unsure at all n locations
acaagagcggagtgccatccccaaccaatccatcactggccatgacctgctcgacgtctacactgtccattgttcccaggacagcccggctgtcacctacattcatgaggtacatgtcctcccctttcataagcatggctagaacgcaagagcccataagcgcaagctccgggaactcgccgaccatcttatcggccacgtccaggtaggcctcctcggtcctgcgaagcgcgcgcgcnagcgccttaagcacggcgaggtggtcgttctggctgctgcnccgaggagggcgctgggtcggcggcttcaggncgctggagcagtcgcgctcccactcgcacttccaccgccgctggtcntcgtnnnnnnnnnnnnnnnnnnnnnnnnnnnnnnnnnnnnnnnnnnnntcctggtgatctgaggccgccgtggtnctggtcggctggtcggggtgcgcgtcgcgctggtcccagagcaggccgcggagctcgcggtgcacggcggcgtagagatgggagacgaggaagtccgtggcgtcggggccgttgaanccgtcgtagatgccgacgaacacccagccccgctcctccgacaccacgacgtggacgcggtcctcgccggccttcccctgcgcccactgca

SEQ ID NO: 204 - DNA, 522 bp, Zea mays
  misc_feature (37)..(37): n is a, c, g, or t
  misc_feature (95)..(102): n is a, c, g, or t
  misc_feature (111)..(111): n is a, c, g, or t
  misc_feature (121)..(121): n is a, c, g, or t
  misc_feature (141)..(141): n is a, c, g, or t
  misc_feature (143)..(143): n is a, c, g, or t
  misc_feature (146)..(151): n is a, c, g, or t
  misc_feature (349)..(349): n is a, c, g, or t
  misc_feature (417)..(417): n is a, c, g, or t
  unsure (1)..(522): unsure at all n locations
tgtttgggttgatttcttcgtttgtcggtaaggaagnacggctggatgctggatcactcgggatggcggattgttccacgagtgcgttttttttnnnnnnnngtgtgtgcntgcttcgtgngatctcatcttagtgtatancngtnnnnnntgtgaccattcagcgatctaatctagatcagtcttgccgggatgtatagtggaatccctccatcattgcggttagctaagcatttgtttggtggatggtggctggtggctggcgggtttgtagtaatagctgttattttccaaatagattgggtctcaaccaactgaaaccccaccccctcgttaagtccgcctttcngtgtgctgagcgagtgaacaatgcccacttcgtgtgaacctctaattcagcttatactaggacatcanaattgctcggtttaggcctgaatacaccttttattacttgtttctgttggtggtcatcatgtatttaggtgtattcggtatgttcttccttggttgctaattcag

SEQ ID NO: 205 - DNA, 663 bp, Zea mays
  misc_feature (124)..(124): n is a, c, g, or t
  misc_feature (180)..(180): n is a, c, g, or t
  misc_feature (292)..(292): n is a, c, g, or t
  misc_feature (342)..(342): n is a, c, g, or t
  misc_feature (556)..(556): n is a, c, g, or t
  misc_feature (611)..(611): n is a, c, g, or t
  misc_feature (622)..(622): n is a, c, g, or t
  misc_feature (629)..(629): n is a, c, g, or t
  misc_feature (638)..(639): n is a, c, g, or t
  misc_feature (646)..(647): n is a, c, g, or t
  misc_feature (650)..(661): n is a, c, g, or t
  unsure (1)..(663): unsure at all n locations
cataatttcatgtactgttcgtacagagattatctttagagagaatagtaagtactaccttcgttcttgaatatttatcatctgctagtttaattttaaactaaaacgtgataaataaaaaaancgaagagggtatcttctatcttgtaataccaaccacgtgaagaccttcactccacngttgttttgcctttttagattatattaaaactttgcccatacaaaacagtttcttagggaaatttccagatttatctcactcgcaattaccaactggccatcgttatttttnagaacgatatcttgcaatcttctaagctgactctgtaaatcttcacgtanccatctcctaaaaatgaggctctagtttttatatttcatggcttcaactgaacaatcacggtcctcgttttttttaaaaaaaatgagaaaagtgtgtctttaaagtaacctatagccacaccatctagtatgccaaaaaaatggtggatttttcattggccgacaccgtagacctgctgcttaagtaaatatatctggtttggggttaattagnagtatgccactccaaatttaaagagttataaagtagtttattttcatgtcgctcnatgacatcaanatgaatnacctatctnnttttatnnaannnnnnnnnnnngt

SEQ ID NO: 206 - DNA, 744 bp, Zea mays
  misc_feature (71)..(71): n is a, c, g, or t
  misc_feature (116)..(116): n is a, c, g, or t
  misc_feature (130)..(130): n is a, c, g, or t
  misc_feature (184)..(184): n is a, c, g, or t
  misc_feature (190)..(190): n is a, c, g, or t
  misc_feature (422)..(422): n is a, c, g, or t
  misc_feature (671)..(674): n is a, c, g, or t
  misc_feature (683)..(683): n is a, c, g, or t
  misc_feature (687)..(689): n is a, c, g, or t
  misc_feature (692)..(694): n is a, c, g, or t
  misc_feature (696)..(696): n is a, c, g, or t
  misc_feature (698)..(704): n is a, c, g, or t
  misc_feature (720)..(725): n is a, c, g, or t
  misc_feature (743)..(743): n is a, c, g, or t
  unsure (1)..(744): unsure at all n locations
ctgcagcctaagtggaaggttaaatgaattctggatgttcttcatgttataactaatgtctcatttggttncgatgctcacatctggttcagtgttggaatctgggaccttccccnatcctcattgcccntgaaatctgattagcatgacttattttttgctacaatttctttggatctttttntttacntcctactagaacttgatgcacctttaattgaggtgtcagcaaatcctggggatcatttgcttgcagtgccaagttagcggtatttgtataggtaaaccctctgtgaatgaatgcagaattcaggttataggctggatgcgatttgagctttaaaagagattgctttttaacaaactgaacacctgcactcacaggtgctacataaataatatgatttcatttagtcgagtcntgtatgttctaaaatatccttaagccctgtgctagcatcttgtgtttgttctatttcaaagatggtttttactgttctttgctgtattgcttctatgcatattctttagagccgtgtgttaacttgtgctattgtgcattgcagaagctagaaaaggcgaaaaccgaagattgaaaaagaccagcaagcagttttagagagcagatgaaaggcgggcatttttgttgatgtcttatctttcgtgtcaannnngtttttgcntgtnnngtnnncntnnnnnnntatctggagtgtatcnnnnnntatgtgatatatatatang

SEQ ID NO: 207 - DNA, 619 bp, Zea mays
  misc_feature (240)..(240): n is a, c, g, or t
  misc_feature (296)..(297): n is a, c, g, or t
  misc_feature (321)..(321): n is a, c, g, or t
  misc_feature (344)..(344): n is a, c, g, or t
  misc_feature (421)..(421): n is a, c, g, or t
  misc_feature (496)..(496): n is a, c, g, or t
  misc_feature (513)..(513): n is a, c, g, or t
  misc_feature (579)..(579): n is a, c, g, or t
  misc_feature (597)..(597): n is a, c, g, or t
  misc_feature (599)..(600): n is a, c, g, or t
  misc_feature (616)..(618): n is a, c, g, or t
  unsure (1)..(619): unsure at all n locations
ctgcgtcgtcgtgttgttacgatcgtccttttttttttgaaaatttattgaaggcccgtgcttcttcttctcttcttcttttccttctccactgttttcctcgcatgctacatgacagtctctctctctcgttaactctgttggtgttcttattatttgatccggatgcaagtaatactatacaaacaggaatcgggaatgcacgctcccaatttttgacgcctccatgcatgtagtggnggagttccgtaaaattaacgtccgagatgtactattctatcttttgattttttttnncgtgttttatttaaaaataaacancggatgataaatatttaataacngagagtaacatttaaaacaatccagttaaactatgacaagtagggaaagtggattagatattcgggaacaattactnacaatagaggagaatcacgagcacatggcagcagacagtcaacactcaggacacaacgctcgccgctcaggtggncgttgttcattggccanggaggcactctgcactcgcctatgaataacaaaaaaagataatcaagttgagaaagttatatagcntggaagaagatgtaatgncnngggtggatttgggcgnnng

SEQ ID NO: 208 - DNA, 1285 bp, Zea mays
  misc_feature (130)..(130): n is a, c, g, or t
  misc_feature (167)..(167): n is a, c, g, or t
  misc_feature (200)..(200): n is a, c, g, or t
  misc_feature (212)..(212): n is a, c, g, or t
  misc_feature (268)..(268): n is a, c, g, or t
  misc_feature (479)..(479): n is a, c, g, or t
  misc_feature (560)..(560): n is a, c, g, or t
  misc_feature (562)..(562): n is a, c, g, or t
  misc_feature (592)..(592): n is a, c, g, or t
  misc_feature (608)..(610): n is a, c, g, or t
  misc_feature (617)..(640): n is a, c, g, or t
  misc_feature (657)..(658): n is a, c, g, or t
  misc_feature (662)..(665): n is a, c, g, or t
  misc_feature (667)..(667): n is a, c, g, or t
  unsure (1)..(1285): unsure at all n locations
catggactttggctaaaggacaagacaccttcaccccaattagtgcagtagtaagcaatgatttttcttccctgtgcttggagttggttggtggtggataaggacaatatgttttatttatttgtactcncttgttataattacacctcaatgaatcaatgccatantcaggttagtcatgcagaagtgttgttagatanaaacacttgatntttgttgccttccatgctctccgcaggcatctagtgacatgaaatgtgtaatcccntcattattacacaccatgttttttacttaagttaacaataatttctccatcaaccaggttccaaaatcagctgtcactaatcccgatgatctcgagctctggctgaaggtctctcaaatgtgtactgaatttgtttaatgttacctgaattgctagagcatatggtgtacaattgactaccaactgcatccaggtagatgatgaactaagncagaaaggaccgacaagcgacatgctattcaagattccttttctgataagctatatcagttccatcatgacattaatggangntgatgtgatactaacaggtagtgacatctnctctacgtgtagcttnnntttgcannnnnnnnnnnnnnnnnnnnnnnncatttgttcctcaacanntacnnnngngggtgtgggtcctgtccgagtaggtcagaagattacagctggtataactgacctaattgatgttgagttcgatgttcagaggcgcaatcggtcattttccacatgatgcaataagcaagaaagtaatggtaagcaacataagatagtaaaggtgcatgcttttatttgttgtgtgactgaaaataatatcaggcaattgatttcatataagcaaaacctgtttacccatagcaagaccagtctgatcagagagggcaccatcgtatccatgttcgaggacatccttgaagatgtactacaattggacagccagatggtgtatatgtatagggtatagggccaatatgccagaactgtgttatggggcatcatcataacaaattgtgctaaagctacgttgtcctactccacattctcacatatacatatcaatcaaaacctgaagtacatgaactacttatcagttagaagctgtgctgtatgaactattgttaccgtgatttctttaaaagaatatatgctattgttggattagttataatgatcttaacaatttcaatagtaattattgatgcctatgcgggattcagcgacttaattatttctggctcgtgctgt

SEQ ID NO: 209 - DNA, 654 bp, Zea mays
  misc_feature (244)..(244): n is a, c, g, or t
  misc_feature (602)..(603): n is a, c, g, or t
  misc_feature (611)..(612): n is a, c, g, or t
  misc_feature (614)..(615): n is a, c, g, or t
  misc_feature (617)..(617): n is a, c, g, or t
  misc_feature (653)..(653): n is a, c, g, or t
  unsure (1)..(654): unsure at all n locations
cacccaccaggacttcgctgggcacaagggcaccatcaagacaggggacgtgcagtggatgacggcggggcgaggcatcgtgcactcggagatgccggcgggggacggcgtgcacaagggcttgcagctctggatcaacctctcctccaaggacaagatgatcgagccgcggtaccaggagctggagagcaaggacatcagccgcggggagagcgaggacggcggcgtggaggcccgcgtcatngccggggaggccctcggcgcggcgtcccccgtgtacacgcgcacccccaccatgtacgtggacttcaccatgcgccccgggtctcgcctgcaccagcccgtcccggagggctggaacgccttcgtctacgtcgtcgacggcgagggcgtgttcgggcgggagacggccacggcgcactactgcctcgtcctcggccccggcgacggcgtcagcgtgtggaacaggtccaccaggccgctgaggttcgtcctcgtcgccgggcagccgctcggcgagcccgtggtgcagcacgggcccttcgtcatgaactcgcgcgcccagattcagaaggccatggaggactactactatggcaagnncggcttcnngnngnccggacagtggagctcctccgcctgatcggcgaggng

SEQ ID NO: 210 - DNA, 545 bp, Zea mays
  misc_feature (511)..(514): n is a, c, g, or t
  misc_feature (518)..(542): n is a, c, g, or t
  unsure (1)..(545): unsure at all n locations
agaagatcaacggggagatgttaagagacggaaaccacacgctaaccgcaatgtggatgggggacacacggcgaaagctttgcaaacctgtcaggcgcttcctctttgttgataagtgaaatgttttttgaggagagaagttgaaagaacttggcagcatcaccttccttcaatctctcgtaaatcttcgttaggaactggttgaattcctgtggttcctgatcacggatggcgatgcccagtgtaaacagagaggcaatagctaatttgctacgacaactgaccagttttatggagaccgagcaagcatgctaatgaactaatagttagcggcccctctaaccaatagttggcaggtctattagcaggcatgttttgatccatacctattaatttaagctgctagctattttagcactactcatgtaactatcatgagcttttcgagaaaaaaaatgtaactatcatgagtgcttacctgttcaataatacaggccttccgcagagaagnnnnacannnnnnnnnnnnnnnnnnnnnnnnncca

SEQ ID NO: 211 - DNA, 668 bp, Zea mays
  misc_feature (134)..(155): n is a, c, g, or t
  misc_feature (252)..(276): n is a, c, g, or t
  misc_feature (481)..(482): n is a, c, g, or t
  misc_feature (497)..(499): n is a, c, g, or t
  misc_feature (502)..(502): n is a, c, g, or t
  misc_feature (528)..(528): n is a, c, g, or t
  misc_feature (534)..(534): n is a, c, g, or t
  misc_feature (551)..(556): n is a, c, g, or t
  misc_feature (568)..(570): n is a, c, g, or t
  misc_feature (575)..(575): n is a, c, g, or t
  misc_feature (578)..(580): n is a, c, g, or t
  misc_feature (585)..(585): n is a, c, g, or t
  misc_feature (588)..(589): n is a, c, g, or t
  misc_feature (595)..(596): n is a, c, g, or t
  misc_feature (611)..(612): n is a, c, g, or t
  misc_feature (616)..(619): n is a, c, g, or t
  misc_feature (621)..(631): n is a, c, g, or t
  misc_feature (633)..(635): n is a, c, g, or t
  misc_feature (647)..(648): n is a, c, g, or t
  misc_feature (650)..(650): n is a, c, g, or t
  misc_feature (652)..(653): n is a, c, g, or t
  misc_feature (664)..(667): n is a, c, g, or t
  unsure (1)..(668): unsure at all n locations
tccataatctctatgagcaatagactggcatatcgattcagtaatcaactgtacatcagggatctctcctctttcaagtatcgagtcaagtgcatgctccagcaaatatggctgcacataaaatcataaagagnnnnnnnnnnnnnnnnnnnnnncaattcctattttggtcacttctaatataaaaaaggacagacccagtgttggcactcccacttaacttttgcagagagtttatatcgaactcgaccnnnnnnnnnnnnnnnnnnnnnnnnnccacaactacatctggcatgaagttgtagctatttagcatatgtcctttcaattgaagtacacaaagtgtaaacataaccaaaaagttttcagtgcacatctctactacttattgagacgatattgtagaccatatgcacaaccatccaccctcgtcgtgttgttcgttcccggccgatgcgtgcagtgtcggcaatctcaccgnngccttgtcgcattgnnntcnggtctgctgtagatatgcctagtcgncctgtnttccttccctctactannnnnncatcggggagannnggagnacnnngcatncgnntggaannagatctatcgagttnntgtnnnnannnnnnnnnnntnnncatatgatacanncncnntttctgcacannnng

SEQ ID NO: 212 - DNA, 801 bp, Zea mays
  misc_feature (4)..(22): n is a, c, g, or t
  misc_feature (26)..(27): n is a, c, g, or t
  misc_feature (33)..(43): n is a, c, g, or t
  misc_feature (55)..(67): n is a, c, g, or t
  misc_feature (71)..(75): n is a, c, g, or t
  misc_feature (96)..(96): n is a, c, g, or t
  misc_feature (361)..(361): n is a, c, g, or t
  misc_feature (401)..(401): n is a, c, g, or t
  misc_feature (590)..(591): n is a, c, g, or t
  misc_feature (742)..(747): n is a, c, g, or t
  misc_feature (749)..(749): n is a, c, g, or t
  misc_feature (751)..(757): n is a, c, g, or t
  misc_feature (764)..(764): n is a, c, g, or t
  misc_feature (770)..(786): n is a, c, g, or t
  misc_feature (788)..(800): n is a, c, g, or t
  unsure (1)..(801): unsure at all n locations
gaannnnnnnnnnnnnnnnnnnaganncttcannnnnnnnnnnatgcagttgatnnnnnnnnnnnnnagannnnngagcgtgaaatacagaagggnccgcatgagaaccttcaaggtttcctagatgcagttgatcgcttgagaagtattgagcgtttctttagttcaaatcggagttaccgtagtagcgatggggtgctcaaccacgtaaacgcgctcctttctaaggcccttgtcaggatggagggtgaattccagaatcaattatcccagcgcaggtttgtgtctcattattaattcgtaattgatcattttgctatctaaaacacacctaatccttgcgctgtgcaccctcctaacngatttcagcaaaccgatggagcctgatcgtctttttgatngtcttccaagtacacttcgaccatcgtctgaatctcagcccgaaggtgggaaaaacccatccgagaatcagcaaaacccagaggctgttgtatatagtcctcctgctcttattgagccaaagtttgttccactactctctaaattagcacaacagttggttcaagctggatgccaacagcaatgctcannaatatataggtacaatgatttacactgatagttttgcactttctattgttatcggcatgcaaaaaacttttctcgtttctgtgtgcccctgttgtgtctgctaagactctaagagatgcagtacagttgtacctgatggagtgacttagtnnnnnntntnnnnnnntatgtgnagtgannnnnnnnnnnnnnnnntnnnnnnnnnnnnna

SEQ ID NO: 213 - DNA, 1016 bp, Zea mays
  misc_feature (1)..(4): n is a, c, g, or t
  misc_feature (10)..(10): n is a, c, g, or t
  misc_feature (14)..(18): n is a, c, g, or t
  misc_feature (20)..(20): n is a, c, g, or t
  misc_feature (24)..(24): n is a, c, g, or t
  misc_feature (26)..(34): n is a, c, g, or t
  misc_feature (37)..(39): n is a, c, g, or t
  misc_feature (42)..(42): n is a, c, g, or t
  misc_feature (44)..(47): n is a, c, g, or t
  misc_feature (49)..(49): n is a, c, g, or t
  misc_feature (53)..(53): n is a, c, g, or t
  misc_feature (55)..(56): n is a, c, g, or t
  misc_feature (170)..(170): n is a, c, g, or t
  misc_feature (530)..(530): n is a, c, g, or t
  misc_feature (701)..(701): n is a, c, g, or t
  misc_feature (827)..(848): n is a, c, g, or t
  misc_feature (881)..(882): n is a, c, g, or t
  misc_feature (934)..(934): n is a, c, g, or t
  misc_feature (936)..(936): n is a, c, g, or t
  misc_feature (942)..(947): n is a, c, g, or t
  misc_feature (976)..(978): n is a, c, g, or t
  misc_feature (1007)..(1015): n is a, c, g, or t
  unsure (1)..(1016): unsure at all n locations
nnnnaaaaanagcnnnnnangcanannnnnnnnnccnnnccncnnnncntctncnngtcttcgttttcttcacgtccatggcggtcgtctcccatgcatcgtccctacgcttccaatacatcgaccgtcgtcacaacttcaccgccaagcaggcgagcacctcctcctcntcgtccccgtcctctgcacacggcagccgcgaccgccgcccttcgttcgcgctagtgcgccgcgacgcagtcaccggctcgacgtacccctcgcgtcgccacgcggtgctcgacctcgtggcccgcgacaatgcgcgcgccgagtacctcgctagtcgcctgtcccccgcggcgtaccagccgacgggcttctccggctcggagtcgaaggtggtgtcgggcctcgacgagggcagcggcgagtacttcgtccgcgtcggcatcggctcgccgcccacggagcagtacctcgtggtggactccggcagcgacgtcatctgggtgcagtgcaagccgtgcctggagtgctacgcgcaggcngacccgctcttcgaccccgccacgtcggcgaccttctccgccgtgccgtgcggctcggccgtctgccggacgctgcgtacctccgggtgcggcgactccggtgggtgcgactacgaggtgtcctacggggacgggtcctacaccaagggcgcgctcgcgctggagacgctnacgctgggcggcacggcggtggagggcgtcgccattggctgcggccaccgcaaccgcggcctcttcgtcggggcggcggggctgctgggcctcggctggggccccatgtcgctggtcgggcagctnnnnnnnnnnnnnnnnnnnnnnttcagctactgcctcgcgagccgcggcgtcgtnngcgacgccgggtcgctcgtgctcggtcggagcgaggcggtgccggagggcgncntgtggnnnnnnctcgtgcggaacccgcaggcgccgagctnnnactacgtcggcctgtccgggatcggcgtnnnnnnnnng

SEQ ID NO: 214 - DNA, 635 bp, Zea mays
  misc_feature (32)..(32): n is a, c, g, or t
  misc_feature (151)..(151): n is a, c, g, or t
  misc_feature (155)..(155): n is a, c, g, or t
  misc_feature (463)..(463): n is a, c, g, or t
  misc_feature (465)..(471): n is a, c, g, or t
  misc_feature (475)..(476): n is a, c, g, or t
  misc_feature (478)..(482): n is a, c, g, or t
  misc_feature (520)..(522): n is a, c, g, or t
  misc_feature (540)..(540): n is a, c, g, or t
  misc_feature (544)..(566): n is a, c, g, or t
  misc_feature (568)..(570): n is a, c, g, or t
  misc_feature (580)..(609): n is a, c, g, or t
  misc_feature (611)..(633): n is a, c, g, or t
  unsure (1)..(635): unsure at all n locations
ataactacatataatttctattgttatctttngggggtaccatgtgcactaacacatactgcattcgtggatctgtttattatattgtgcaggttaagaaaaagttggtgaatctgggtcatgcacagaggtacgtcgtgatttgctaatntgtnattttaagaaaagggcagacccggtatcgaaggctcccatgtgagtggggtttggggagagaaaccgaggcaagtcttcctccacaaatgtggagaggctgcttcgaatcagcgactggtgcctcagtgagacagctctcaccaccgcaccaggcgtgctcttcgtttactaatctgctatttaataaagcacaatgaacagactaccatctttatgttcaaatcgaaaatagtgaggaatcacttcatttgctgattttaagttcctggcctaatctaaatgttagttttttaaggctttgaattcnannnnnnnattnngnnnnntctgaaaaatgtcattttttattcttatatggaagttnnnaaatatgcaaatatgacnaacnnnnnnnnnnnnnnnnnnnnnnncnnntatgatctannnnnnnnnnnnnnnnnnnnnnnnnnnnnntnnnnnnnnnnnnnnnnnnnnnnntg

SEQ ID NO: 215 - DNA, 829 bp, Zea mays
cccagggatcctatagagatcacctgcagtctgggtagccacggactcaccacgggcaacgcagccccgaaccaccactagtccactgtccaccaccctccagtcctccgtccggatggatggattgactggtcactggcgaccgtgtaggccaactctgttgcttgccagtgccagtgccagtggcactgccactgccactggcagcgagcggcgccatcccgaaccataggtttgccctcagcctcgggctggctactgcgacgtgtttgtccagttttgccctctagattctgcccaatgtgttcaaaaaccccgtcgtcggtttagcgtttcgagataaccttaaatattcgcgaggttgcatgggtttcggcacggagtacaaaccagatactagggcctctttgttgaagatcatatattatataatctagattagaatctatattatataatctagattataatttgtgaaggttataatctatatatagtcgtttggttgcacagattatataaatgcagataatacacaagtacaaactagatagtagataatatgttgccgttctttaaacactaaggtcccgtttggttccattagttttagagctaaagtttagtccgtctcaccctatttgattgtagtgacttaatagattttaaatacattagattcaacacataaagaccgacataccattttttttcttatttcctatgtatgatgccagttttctaggtaagggtaattgagtaaatgttgtcttttcaatccttttagcacccctatgagggactacaagttaaagtcaattagtatcta

SEQ ID NO: 216 - DNA, 600 bp, Zea mays
  misc_feature (11)..(13): n is a, c, g, or t
  misc_feature (15)..(16): n is a, c, g, or t
  misc_feature (454)..(455): n is a, c, g, or t
  misc_feature (478)..(484): n is a, c, g, or t
  misc_feature (486)..(515): n is a, c, g, or t
  misc_feature (517)..(517): n is a, c, g, or t
  misc_feature (519)..(526): n is a, c, g, or t
  misc_feature (528)..(528): n is a, c, g, or t
  misc_feature (530)..(540): n is a, c, g, or t
  misc_feature (548)..(554): n is a, c, g, or t
  misc_feature (556)..(562): n is a, c, g, or t
  misc_feature (567)..(599): n is a, c, g, or t
  unsure (1)..(600): unsure at all n locations
gaaacaatatnnntnnagtaacaataacacacaaactggcagtccttcagttagctagctatgaatactatcaaccagtacctggacatatgatagctgaacaaacattggatcagtcacagcctcatccgactcacggaagagacgtttcttgaatacgagtttgcaatgaagaatttctcctttgttgcgatccttagctgatttgaattcagatagcaagtcaccaatatatttgttatcatctaatccaatgtattcctctgcatataaaagataaagaaatgcaccgtgttacttgaaatttttctacaaaatccacctacgtttcctcctgctccatgatatccaaaccacatgcattaattaaattaagaaatagaaaagaaaaaacaatatggattggtaattaccattgccaatctctgaagactttgatccattaacaaccttnngacattcaaataggctgaagctnnnnnnnannnnnnnnnnnnnnnnnnnnnnnnnnnnnnancnnnnnnnngntnnnnnnnnnnnattagtannnnnnnannnnnnntgatnnnnnnnnnnnnnnnnnnnnnnnnnnnnnnnnng

SEQ ID NO: 217 - DNA, 912 bp, Zea mays
agaagtgcagaactccagcaccaacggctgctcacctgcaccccctgctgtcctgctccattcaacggcgcctgcgcccctctgcctgcttggctgctcgcctgctccagtccagatatcagcggctactccagcaccattgacttgatgagctcgtcatctcaaggttcctcctgctccccccccccccctctcccggatggttgctgtcgtaatcctaagccagtgatgactgatgagtagtgacttgtacttatgtctctgtttgcaaactgctattttgtttatgtagctgtttgttctaatttatataatgtatataggtatatttatatatgtatatacctatataagtgtaactacaagtctaaaaggtctaggacgactaggggtcaactagtcgccttggtcgtcgcctaatcgcaattagtcacctagtcaatcctggggagcaaccaggcgacttgcaatcattggattggatgccactgtagagcatctgatttgatcctactattggtgactggattttaaaagatggaaattgagggtccatggatctacaaaacacaaatcttgcagtaccaaagtaataatgcagataacacacaacattcaaatagcagcaaatgcaaatttacatgtttactgtcagaaatatatgaggtttcctatcagcaaagatcaagtaacacacaaacatcatcaagtcaatagcaatgaacagaagacgttaaataaagcggtaagaagataaactaagattagctaactggaaccagcaagattttgaaatatgagacttacagacagcaatgcaccagcctgttcaacaataatttgcctagtagagtgcatattttcagctagcaatgatgcattatgaagcccaagcacagaagctgattcagg

SEQ ID NO: 218 - DNA, 722 bp, Zea mays
  misc_feature (18)..(18): n is a, c, g, or t
  misc_feature (20)..(27): n is a, c, g, or t
  misc_feature (297)..(297): n is a, c, g, or t
  misc_feature (436)..(436): n is a, c, g, or t
  misc_feature (476)..(477): n is a, c, g, or t
  misc_feature (558)..(560): n is a, c, g, or t
  misc_feature (623)..(623): n is a, c, g, or t
  misc_feature (629)..(630): n is a, c, g, or t
  misc_feature (633)..(633): n is a, c, g, or t
  misc_feature (636)..(637): n is a, c, g, or t
  misc_feature (640)..(640): n is a, c, g, or t
  misc_feature (642)..(645): n is a, c, g, or t
  misc_feature (655)..(664): n is a, c, g, or t
  misc_feature (671)..(672): n is a, c, g, or t
  misc_feature (674)..(690): n is a, c, g, or t
  misc_feature (700)..(703): n is a, c, g, or t
  misc_feature (705)..(719): n is a, c, g, or t
  unsure (1)..(722): unsure at all n locations
ttggtgtgttgattcttnannnnnnnntatgtttatctgcgtatgcatacatgctcaattctttgtgattgataaacgttaaaactgtttagacactagctgaaagttttatatgccaaataagttgttgtactgttacttttgaggactcaataaattatttaatttaatgagctgactctttggaaaatttgttaaattttagacttcaagaaggagcttaggaccctcaacagagagcttcaattgcatattttggagctggcagatatattagttgagagaccatctcaatangctcgtagggtagaagatattacgctcatattcaagaacttacatcatcttctcaattccttacgacctcatcaggtgtgaaccttagattttgtcacgcgcgtatatttctgctattcttcaaagccacgttgattantatctttttagtagtactaacattctttagtatcttttanncaagggccacattgattcacatgcttgagagccaaattcggcaccgcaaggaagcaattgaagatataaagcagtgagtcnnntttctcatatatagtagtgttgaaatcacatttcatgtattcaattttagtctgtgtctatancctttnnacnctnnagncnnnngtcacaattnnnnnnnnnnatttacnngnnnnnnnnnnnnnnnnnctagcactannnngnnnnnnnnnnnnnnnaca

SEQ ID NO: 219 - DNA, 498 bp, Zea mays
  misc_feature (26)..(26): n is a, c, g, or t
  misc_feature (390)..(390): n is a, c, g, or t
  misc_feature (440)..(444): n is a, c, g, or t
  unsure (1)..(498): unsure at all n locations
ggtccttgcagcaggtggcaccttcnatcggacagcaaccccagaccaagcagacgttcctgaaaccaaacgcacagcaacaggtgctgcccgctgcgcaggagaagttctcatcgcagacattgtccggggcaaccgggggaggcggcggcgttggaggggttggagacggcttgggagggtttgcgcccttcttggtagggtaggatgccatcatagcaatcccgcacttcccagtggtggcattgacgttcctctccatacggatgtaaccatcctcgccccactttgcaccccaagagttgcggacaatccagtagtccttcccattttcggtgccgtagccgacagcgacgacaccgtggtcaagattcgtggtgcaagttccantaaagacaccctaaatgaaaaccgaaagacgagtgtaagaacagcagccnnnnnttgctgggccatagcatatgctgctaactgcagcaggttttaccgctttgtaca

SEQ ID NO: 220 - DNA, 512 bp, Zea mays
  misc_feature (20)..(21): n is a, c, g, or t
  misc_feature (151)..(151): n is a, c, g, or t
  misc_feature (171)..(171): n is a, c, g, or t
  misc_feature (181)..(182): n is a, c, g, or t
  misc_feature (215)..(218): n is a, c, g, or t
  misc_feature (234)..(235): n is a, c, g, or t
  misc_feature (240)..(243): n is a, c, g, or t
  misc_feature (246)..(246): n is a, c, g, or t
  misc_feature (261)..(262): n is a, c, g, or t
  misc_feature (318)..(318): n is a, c, g, or t
  misc_feature (324)..(324): n is a, c, g, or t
  misc_feature (354)..(354): n is a, c, g, or t
  unsure (1)..(512): unsure at all n locations
caaaactccaagctgtctgnncagggaagaacagtggagtatagatacatgttcctcatgttctggatcatcatcattagtagtaacgcgcatgccattggtccccggaatgttccgtttttacttgaggggaaatggactcagatctccntcttccatcacgcatgtacnaggcatgcannatcagctcatcttgcattaatattgctatatannnnatccaactacagtatnnatatnnnnatntgaatgatatatacnntgcatgcatggctttcctctggatacgtggtatttcatgtgtatcgatgctttcgnaatacncttgcttcaattctttttctctttttcctngtacacctttgtcactcagattccatctgctggatgagttcgacgatgctaagaagagctgcaggaaacgcctagcggaccacaaccgccgccgccggaagtcaaagccatcggatgctgatgccggagacaagaaaagggcacatgcgaacaaagca

SEQ ID NO: 221 - DNA, 628 bp, Zea mays
  misc_feature (149)..(172): n is a, c, g, or t
  misc_feature (369)..(410): n is a, c, g, or t
  misc_feature (428)..(428): n is a, c, g, or t
  misc_feature (439)..(439): n is a, c, g, or t
  misc_feature (605)..(606): n is a, c, g, or t
  misc_feature (610)..(610): n is a, c, g, or t
  misc_feature (613)..(613): n is a, c, g, or t
  unsure (1)..(628): unsure at all n locations
tgggaagaaaccagcacgcatccgtcgctgtcaggagctgatcagatcggctgctggagttaagacggacggacggcgtattatggacggggaagattcctgatgagatggcgacaccaaaactgaaagccacgggcctggatcctctnnnnnnnnnnnnnnnnnnnnnnnngattttctcccggattttcatattactattctctactagggatggatggtgtatgtacacaccgatacaatcaaggaccgtatcagcaggttgaataataacaacgataataatctactgacacgcgcaagtattttggggctaatcatcggggtggatgctgcatgccgacgaggagatcgagggggaatcggacnnnnnnnnnnnnnnnnnnnnnnnnnnnnnnnnnnnnnnnnnnaagtcccacagctcgtcntgctcctcctnctcgggcatctgccactgctcttgagaaatctcgccggactccagtagctccaccacctgcacattggtggccatgtgaatccagtcagttaagtaccaacagtgccaaatttaataaacagcactggagcttcaattgaccggtccagccgtccaggtccaggannaggngtnacctctgccaacagc

SEQ ID NO: 222 - DNA, 255 bp, Zea mays
cagcttgcatgcctgcagaaaaccgaaccccacgacgaaaccaaccaacactcgcgggaaaatagcgatgagaagatgcaggcccagtactactccgactctcctacagtttagtttcccaagccctcagcctcacagcccggcccacaaacataaatgcaggcccatcgacgcgaccagaccacccgcataataataaatggccaaatgcaggagtggcgcccacgagtcggtgatacaacgtcactggtactg

SEQ ID NO: 223 - DNA, 360 bp, Zea mays
  misc_feature (291)..(291): n is a, c, g, or t
  unsure (1)..(360): unsure at all n locations
aacagcagtcagcatttcaaatacgaaagactggaactgtggagcaagtaacaacactcacatcatttctaacacttggaattgctaaattctcagcattcttgattccaagggtagtgagctcccgtagagatgtctgtttcagaatgcaggctcatcagttagaatcaatcagagccagacacaaccatcaaatgctactgcattgtaaaaattgcacgagcaaaacgcatgacaggagtacgcatcctgcaaacacgaagcgctcaatcattgatgcctgagaagatncagcactgaccgtccggcgcgacacatagggctgcgagccccaccgcttggcccatccgctctctctca

SEQ ID NO: 224 - DNA, 210 bp, Zea mays
  misc_feature (202)..(202): n is a, c, g, or t
  unsure (1)..(210): unsure at all n locations
atggttatggctatgtacattacatagaatttggtacgtacatgatcatcatctgcatgactgcattttgtgtatggcgtttgtcagttcgcaatgacagggtgttgatttattctgtgccgtaagcattctatgtctcagctttcccatggaactcaatcaaaacagaacatacgatttcagatagactgggtgtaactgncattttcc

SEQ ID NO: 225 - DNA, 718 bp, Zea mays
  misc_feature (14)..(14): n is a, c, g, or t
  misc_feature (81)..(81): n is a, c, g, or t
  misc_feature (96)..(96): n is a, c, g, or t
  misc_feature (124)..(124): n is a, c, g, or t
  misc_feature (166)..(166): n is a, c, g, or t
  misc_feature (231)..(237): n is a, c, g, or t
  misc_feature (239)..(239): n is a, c, g, or t
  misc_feature (267)..(267): n is a, c, g, or t
  misc_feature (301)..(301): n is a, c, g, or t
  misc_feature (348)..(348): n is a, c, g, or t
  misc_feature (358)..(358): n is a, c, g, or t
  misc_feature (360)..(360): n is a, c, g, or t
  misc_feature (375)..(375): n is a, c, g, or t
  misc_feature (395)..(395): n is a, c, g, or t
  misc_feature (398)..(398): n is a, c, g, or t
  misc_feature (403)..(403): n is a, c, g, or t
  misc_feature (414)..(414): n is a, c, g, or t
  misc_feature (434)..(434): n is a, c, g, or t
  misc_feature (439)..(439): n is a, c, g, or t
  misc_feature (474)..(474): n is a, c, g, or t
  misc_feature (500)..(500): n is a, c, g, or t
  misc_feature (511)..(511): n is a, c, g, or t
  misc_feature (553)..(554): n is a, c, g, or t
  misc_feature (556)..(556): n is a, c, g, or t
  misc_feature (582)..(583): n is a, c, g, or t
  misc_feature (598)..(598): n is a, c, g, or t
  misc_feature (606)..(607): n is a, c, g, or t
  misc_feature (612)..(612): n is a, c, g, or t
  misc_feature (614)..(614): n is a, c, g, or t
  misc_feature (621)..(621): n is a, c, g, or t
  misc_feature (639)..(641): n is a, c, g, or t
  misc_feature (650)..(652): n is a, c, g, or t
  misc_feature (656)..(656): n is a, c, g, or t
  misc_feature (667)..(668): n is a, c, g, or t
  misc_feature (674)..(674): n is a, c, g, or t
  misc_feature (676)..(686): n is a, c, g, or t
  misc_feature (688)..(699): n is a, c, g, or t
  misc_feature (704)..(716): n is a, c, g, or t
  unsure (1)..(718): unsure at all n locations
cgtaacttgcgaanaacgaacgagttttgccacagcaggacgatccttgtaccgtcgtccgcaagggttgtaatttctcanggaccgttacgacangattgtatgtcaggttttgacagtttgngccaatgcaattcttctaatgaaaaagacaagtgcatgtgantggttagcatctgcctatcgcctatcgggtatcatgtggagtcgtctggtataccgtcctacacnnnnnnncntgagaacgaagcaaccttacccccaacnatcaccttgtagcgatccgaagttgttcatcttngagtttcagttctctaactccatcgtagctaagcgtttcagcaatgngtcaagagananatttaactatttgtnaccgttaggaaggccacatnttngtttncttgttttacntggcaactgtacgatttttnatcgnaaacgctaactggtctattttattgatgtaccatnttaaattagcatgtcacggtggatcntagtctttttnccggagagacacctggaaagtcatttttaccttcgcattttnnantatttagtgcgttatgtgcaatttgnntagaattctatcatntagattgnnatatntnaatattnaatgcaatactagtagtnnngatttttgnnnactnatttgaagtannatgagntnnnnnnnnnnnannnnnnnnnnnntgagnnnnnnnnnnnnnca

SEQ ID NO: 226 - DNA, 726 bp, Zea mays
  misc_feature (577)..(578): n is a, c, g, or t
  misc_feature (628)..(629): n is a, c, g, or t
  misc_feature (638)..(639): n is a, c, g, or t
  misc_feature (641)..(641): n is a, c, g, or t
  misc_feature (650)..(651): n is a, c, g, or t
  misc_feature (653)..(653): n is a, c, g, or t
  misc_feature (660)..(660): n is a, c, g, or t
  misc_feature (665)..(668): n is a, c, g, or t
  misc_feature (671)..(672): n is a, c, g, or t
  misc_feature (679)..(683): n is a, c, g, or t
  misc_feature (701)..(701): n is a, c, g, or t
  misc_feature (703)..(707): n is a, c, g, or t
  misc_feature (711)..(725): n is a, c, g, or t
  unsure (1)..(726): unsure at all n locations
tagaaggaccatggaaataacaatgcggaaaggagcagaccataggctgtgaagctgctggcacacttgctgcaaaggtacaaatctaaattagaagggtgcaaaaccaaaagccataaatggctagcatgcatggcatccacacatggcactttctccttccttcagtccttccatcttttgtaacattgacccagtctaacacaaaagtatacctgaagggactccgcatcagttgaaatcaaattggtaatcctcccagaagcaaactttctacgactatcattagttagtcgcaaagatttgcggaaaacagctgcaatctgcacaagaacaaaaggtcaaatttcaatgtaaactttgatgaccatacctaaaagaaaaattcaaaacatttaacatagaaatcatatagcgggtctgcattctagatgataaagacaaattcgcattgaactaatatcactaccaacaaaactaggtatattctatgatgttaagggggaatttgcaaaaacaatctcattatgtcattaagttccctaccaatatctacctggactaaaaggctttgtanngaatccacatgttatgacaaatctggagttttgatccccaatccaatctnngtaaaagcnngnatggtctcnngnatgtggnacgcnnnnttnnaattttnnnnnatgcatgtttactgtacnannnnntacnnnnnnnnnnnnnnng

SEQ ID NO: 227 - DNA, 514 bp, Zea mays
  misc_feature (49)..(49): n is a, c, g, or t
  misc_feature (85)..(85): n is a, c, g, or t
  misc_feature (259)..(259): n is a, c, g, or t
  misc_feature (268)..(268): n is a, c, g, or t
  misc_feature (418)..(418): n is a, c, g, or t
  misc_feature (457)..(457): n is a, c, g, or t
  unsure (1)..(514): unsure at all n locations
cctttctaatgtcaaagttctgctccttgcgctctccctaaacaagcangaagtatcaagcacaaaagtctatatctagaacaangcatatgatttaaaaccatcagatgccagccagatataagttacctggacatagatatcgaaaaccctcctccctcagcttctccaagactgcatgtctggaaagtcaacctctgcaaattgaagtgtgaccgtgtaatttccattctcaagtccaatgccatagtatctcagngatgatggngacatccttgctgtttggaacagtgcagagtctagggtgttctcgaactggcgtgaactgtagatgatgtaacttgcattgggtgcatctgcgtccaagaataacccaacgctgctaacggcccatgtaggtgcacccgcaacatagtangatgcagcactaaggttggcattatcagcttgatagacngaattatctgaacctgatattgctctactaccaccacagtccaccgcaaaggacgca

SEQ ID NO: 228 - DNA, 667 bp, Zea mays
  misc_feature (5)..(7): n is a, c, g, or t
  misc_feature (150)..(157): n is a, c, g, or t
  misc_feature (537)..(537): n is a, c, g, or t
  misc_feature (541)..(542): n is a, c, g, or t
  misc_feature (550)..(580): n is a, c, g, or t
  misc_feature (588)..(590): n is a, c, g, or t
  misc_feature (595)..(595): n is a, c, g, or t
  misc_feature (599)..(605): n is a, c, g, or t
  misc_feature (607)..(609): n is a, c, g, or t
  misc_feature (614)..(614): n is a, c, g, or t
  misc_feature (619)..(626): n is a, c, g, or t
  misc_feature (628)..(634): n is a, c, g, or t
  misc_feature (638)..(638): n is a, c, g, or t
  misc_feature (647)..(648): n is a, c, g, or t
  misc_feature (652)..(653): n is a, c, g, or t
  misc_feature (657)..(657): n is a, c, g, or t
  unsure (1)..(667): unsure at all n locations
gtccnnnatcaggtcccgcagcgtggcgtactcgtagtcgtagctccggccgctcttggccgccgacagctcgatcaggtaccggtccgtcgggaagtcgtcggacgcgcgcagcgacccgctgtggatctgcgccacgcaacgtacgtnnnnnnnngtcactaagcggtgcaagggccaggcagcaacagggaacctcatgattactatagtatacaaacaagcaaaaacgaggaggatgatcggcaccttgaagttgccgccgccggatgccggcagcgtgaggggccccttgatgaggtacgtgccgccgtcgaggtgcacctcggcgccgccgaggtcggggatgccgccggtcatggtggcgttggtgggcgggcggaacgcgtcagctatggccttgctgatcgccgccgtggcgtcggcggcgccggtcgggtccgcgccgtagtccgtcacgtggtacacccgcgcgctcgcggaagcctgcgccgtccatccacgccaggtcagacatacgtggcagtacagttcagncttnncaagggtnnnnnnnnnnnnnnnnnnnnnnnnnnnnnnngctttgcnnntgaantaannnnnnncnnnaatcntgtgnnnnnnnnannnnnnnacgngtagctgcnnagcnnctgncgtttggcgt

SEQ ID NO: 229 - DNA, 678 bp, Zea mays
  misc_feature (354)..(354): n is a, c, g, or t
  misc_feature (577)..(578): n is a, c, g, or t
  misc_feature (603)..(603): n is a, c, g, or t
  misc_feature (637)..(637): n is a, c, g, or t
  misc_feature (639)..(639): n is a, c, g, or t
  misc_feature (641)..(651): n is a, c, g, or t
  misc_feature (655)..(658): n is a, c, g, or t
  misc_feature (664)..(664): n is a, c, g, or t
  misc_feature (671)..(673): n is a, c, g, or t
  unsure (1)..(678): unsure at all n locations
atttagcattacaccaaaatgcaaagaaatgtccattgttcaaaaactttttcctatatcatcatagtaattgaactttttcttggaatcaagtataaatgaacagataatgcttgaataccttaaaatatacgccttttttccttccagtgccatcatagcgtattccaataagcttctgtacaacaaattcatccttgtcaagagtgtcagcatcctcttgatcctctgaacctgctaaattcgaatccacatcttgatgaacatatttttcacataagactgcccattccttaaggagagcaagaaactcatcagctttctcatttcgcacctacattcaaaggtccaaanaaactttttgagagcagctggacagaacagatggaatccaagatgcagcttaatatgcatacctcagtctgtggatgattgtattttaaactttggcacgcaaaactgttaagatcaacagcccatcgctgcaatcatagccataacagtagaatcagtggtaagtaagaacatgttctatccaacagataactaggtagaatattacagtttcaagtttcannccagaaagagcagcacccaagcaangaccagtggacatgcccccacagcccgaatacangncnnnnnnnnnnnctgnnnnctctgncatattnnntgacg

SEQ ID NO: 230 - DNA, 576 bp, Zea mays
  misc_feature (504)..(506): n is a, c, g, or t
  misc_feature (513)..(513): n is a, c, g, or t
  misc_feature (516)..(530): n is a, c, g, or t
  misc_feature (532)..(563): n is a, c, g, or t
  misc_feature (566)..(571): n is a, c, g, or t
  misc_feature (573)..(573): n is a, c, g, or t
  misc_feature (575)..(575): n is a, c, g, or t
  unsure (1)..(576): unsure at all n locations
gtctatttgccttgtattctttgatttgtagaaatgcaaaagtgagtctcattccaaaccaagtacagtctgagaagaggatgtcaagttttcgactcaagcttccaacaccagagcttgagagatccataaaagtaaaagagaaacttgaatcgtcactactgttgaagaaggtgcttctaggcttagtcttgtttgggacttctatgtttatatccaatggagttatcacaccagcaatgtcaggtttgctttttttcattctctccacacttcaacttaaatcactaaagttctgttagtggattaaccatgaagaatactatagacatcgaatgaatgtttttattttccatgtcattcaaacttatttcagtgctggagtgttttttccagccaaagtaattatttatccttgaatgtagtgttatctgctgtcagtggcttgaaagttgggctaccaaatacctcacaaggtgatttctttggggttaaaatttctcnnntcttatngcnnnnnnnnnnnnnnnannnnnnnnnnnnnnnnnnnnnnnnnnnnnnnnacnnnnnntncng

SEQ ID NO: 231 - DNA, 590 bp, Zea mays
  misc_feature (4)..(4): n is a, c, g, or t
  misc_feature (14)..(14): n is a, c, g, or t
  misc_feature (17)..(19): n is a, c, g, or t
  misc_feature (44)..(44): n is a, c, g, or t
  misc_feature (48)..(48): n is a, c, g, or t
  misc_feature (196)..(196): n is a, c, g, or t
  misc_feature (364)..(364): n is a, c, g, or t
  misc_feature (383)..(385): n is a, c, g, or t
  misc_feature (401)..(402): n is a, c, g, or t
  misc_feature (418)..(418): n is a, c, g, or t
  misc_feature (433)..(434): n is a, c, g, or t
  misc_feature (489)..(497): n is a, c, g, or t
  misc_feature (501)..(503): n is a, c, g, or t
  misc_feature (505)..(511): n is a, c, g, or t
  misc_feature (528)..(535): n is a, c, g, or t
  misc_feature (551)..(551): n is a, c, g, or t
  misc_feature (553)..(553): n is a, c, g, or t
  misc_feature (557)..(565): n is a, c, g, or t
  misc_feature (568)..(568): n is a, c, g, or t
  misc_feature (576)..(579): n is a, c, g, or t
  misc_feature (583)..(586): n is a, c, g, or t
  unsure (1)..(590): unsure at all n locations
tacnttttcccccnagnnncagtaagttcattgaacttttgggnagcnatgatcagtgaagagtaaagacttccccaggtatgcaaaccctagcccctaggcgacagtatataacatgactagatgtttagaatctagatgtagaaatatttaggtgcaaattagttaaattgattgatgggtacattgttgatgnattatgtacttccttggattgtgaagaaggattgagatatgaaaagacagtaaagtttccgcggttccacagacgtcgtgtgtcacccttccacttcccgctttatgcagcaaaaataaggtaaaattgctttatgcagcaaaaataaggtaaaattgtgcacaactnaggattcaaaacttggtgnnnggctccacattcacanntatctaaccaacagancaacacatatttttnngttttattaaaacaaagtctactcatgtgatatataaaaatcatagcaatgtacnnnnnnnnnactnnnannnnnnnatttattagtactcccnnnnnnnnaaactataaactttcntngatnnnnnnnnnttnttatgcannnncatnnnncact

SEQ ID NO: 232 - DNA, 556 bp, Zea mays
  misc_feature (202)..(202): n is a, c, g, or t
  misc_feature (555)..(555): n is a, c, g, or t
  unsure (1)..(556): unsure at all n locations
gtccttcgtgctctacggcctccttgtgaagcatgggatggaatatgtcaatgatctcttcgttgtcagctcggccatcgtgatgttctctgaactcggggatgtgcagtcagcttggagggtgtttgagtatgctgccaagaagaacaccgaggtttggaacacgatgatcactgggtatgtgcagaacggaaaatttgcngaagctatgggtctcgttatccggttaatggtgtctaaagaggttccattggatgtcgtgaccttcttgtcagcactcacggcagcatcacagtcccaggatggcaggttgggtcagcaactgcatggctacttgatcaaaggaatgcacaccactttgccagtgatacttggtaatgcacttgttgtaatgtactcgagatgtggcaatgtccaaactgcctttgagctctttgatcggttacatgagaaggacattgtttcttggaacaccatgatcactgcttttgtgcagaacgattttgatctggaaggcctgttgctcgtttatcagatgcaaaaatcaggttttgna

SEQ ID NO: 233 - DNA, 662 bp, Zea mays
tgcggcacgtcgccgggcgtccatatcgtattgacttgagccgcctgtggccaaccaaccggatccgccgggccctgagccctggtgccgcgcgcgcgcgtcacggcgtggtcgtagcgtgtttatgagctcgcgacttgcgatcccggccggccggtcagtcagtcaaattaatggggtagcggcaagctatggctacgagcctacggaccggaccgtttgtttaagcggcggcggcggccacccacgcagaggaagtcgccgtcctgctgttcctttctttcacctgcgcttgattgcttttgtaacgtcgaacgaaccactctgctcgcacgttggaaacgccggccggtgacgttctcggccactgctcaacaacagtcatcgccggtactcggacgcgtgcaattgggttagtacaagtcagtggttagcgctttttgggtttccttcagaaaatgaaaaggcccctaatagctagggaggctttagataaacacctccgtgtgtattcagaacatgctgtatgtcccgtgtattcaaaagcaagcttaggcctgttgttagctgaagcaaataaagcgatgttaacagcggcagaaataaagcaaagtgaggcatacgtgacgacggggaaagcatgaatgaaaatatcgctagca

SEQ ID NO: 234 - DNA, 734 bp, Zea mays
  misc_feature (43)..(43): n is a, c, g, or t
  misc_feature (567)..(567): n is a, c, g, or t
  misc_feature (569)..(569): n is a, c, g, or t
  misc_feature (592)..(593): n is a, c, g, or t
  misc_feature (602)..(602): n is a, c, g, or t
  misc_feature (615)..(615): n is a, c, g, or t
  misc_feature (621)..(621): n is a, c, g, or t
  misc_feature (643)..(643): n is a, c, g, or t
  misc_feature (645)..(646): n is a, c, g, or t
  misc_feature (648)..(649): n is a, c, g, or t
  misc_feature (651)..(653): n is a, c, g, or t
  misc_feature (656)..(657): n is a, c, g, or t
  misc_feature (659)..(662): n is a, c, g, or t
  misc_feature (671)..(671): n is a, c, g, or t
  misc_feature (677)..(678): n is a, c, g, or t
  misc_feature (694)..(697): n is a, c, g, or t
  misc_feature (699)..(701): n is a, c, g, or t
  misc_feature (703)..(707): n is a, c, g, or t
  misc_feature (709)..(711): n is a, c, g, or t
  misc_feature (718)..(719): n is a, c, g, or t
  misc_feature (726)..(733): n is a, c, g, or t
  unsure (1)..(734): unsure at all n locations
cctgcagtgtagttgtaaccacaagataggctttccacatgcntaccttccaatgcatctactaaagttggagtgctcctattaaggaagtcacctaaaccaagctgcccttccttgcctttaccccatgtaaacactttcccatttgtagtcaccactgctacatgggaagaacctgatgatatatgtctgacaaactcgctcttaagtagtccttcaacagcagaaacagttttaccatctgcatgggggttccctaattgcccatgcatcgaactgccactagtaaagaccacaccagtaacagagagagcaacagtgagtgccgtcccgcaggacacctgaataaaatcatagtctgtgagtgaatcaacacatgttggtataagcttcatctttttgtcagcatgacccagcttcccccgatctgcatcgccccatgtgaacagcttgcttcttggtgaattgctcttgaaatcactaatcacttccacaatggcagctgtgtgccatggcccacatgccacacatttcactcttgagcctttcaaagactctacttctttngnccgggtagttccttgtgtatctnnatgaccaanaacaccaaatgtnccatcnccatatgtgtataactgaccanannanntnnntanngnnnngtgccaagnaccacnngcaatcttcacaacannnntnnngnnnnntnnnctaaacnntttatgnnnnnnnna

SEQ ID NO: 235 - DNA, 358 bp, Zea mays
  misc_feature (61)..(62): n is a, c, g, or t
  misc_feature (65)..(66): n is a, c, g, or t
  unsure (1)..(358): unsure at all n locations
ccaataaacatgccactagattatccaatatcaatggaccaaactaaactcttgcaaaagnnggnnaacatgcactggttaacaccaattcaccccatagccagcaacagagctagtttacagtaaagagaaattgacattattcttctataaatgaaccttatttatattcatgtgtgcttgatttgtttttaacatacactatggaatatgcacgtccttaaaaacatgcatgtgtgcctataacccaataaacatgacagcattaaagaaattattcatatccgaattacattgaatcctaactgtgaaaatctggaaatggagatgtgaaggaaagagcaaaaggcacacctca

SEQ ID NO: 236 - DNA, 773 bp, Zea mays
  misc_feature (4)..(4): n is a, c, g, or t
  misc_feature (122)..(122): n is a, c, g, or t
  misc_feature (224)..(224): n is a, c, g, or t
  misc_feature (244)..(244): n is a, c, g, or t
  misc_feature (290)..(290): n is a, c, g, or t
  misc_feature (310)..(310): n is a, c, g, or t
  misc_feature (471)..(471): n is a, c, g, or t
  misc_feature (512)..(512): n is a, c, g, or t
  misc_feature (521)..(521): n is a, c, g, or t
  misc_feature (601)..(601): n is a, c, g, or t
  misc_feature (641)..(641): n is a, c, g, or t
  misc_feature (644)..(644): n is a, c, g, or t
  misc_feature (650)..(651): n is a, c, g, or t
  misc_feature (666)..(668): n is a, c, g, or t
  misc_feature (672)..(680): n is a, c, g, or t
  misc_feature (691)..(692): n is a, c, g, or t
  misc_feature (695)..(696): n is a, c, g, or t
  misc_feature (698)..(700): n is a, c, g, or t
  misc_feature (703)..(707): n is a, c, g, or t
  misc_feature (721)..(725): n is a, c, g, or t
  misc_feature (731)..(761): n is a, c, g, or t
  misc_feature (763)..(772): n is a, c, g, or t
  unsure (1)..(773): unsure at all n locations
catncctgcagtgtaagcttgaatctgtctttacaatcgtgaaccataagctgagtcctgttacagggcaactctcctttggcagagggttgaagagagcagagagctatggcatctcatgnttccctgccaagaaagagaagccctgaaactggacagcttaggcattccatttcctgatcatgtaaacaatgagttctttcctctcttatcttgacctcacngttttctgctcactgtgggnctgcggcactgcaatatttatatagtgaacatatccttgataagangtgtacttcttgattttttncgaagggttttaaaccatggatatcctcttggcatccaacatctccctttcccttttgccctcatggttttgtctctctgaagttctcaccccactatcggattccctttctcgttcgagatcgagacccttctttggcaattggcactagccacagaacngtagctgctggtgattttcactttactaagacaaaccgatngttcagtantttgactacacagtaaagttagtgatgctgccacacttactgctggcgatttccattttcttaagagaaaacaattgtcnagtacagcatttgtctatttgaccacacagtaaaattagntgntgctgnntcactaatgtttctnnnctgnnnnnnnnnacatgatctgnngcnnannngcnnnnntcactcataatagnnnnnatagtnnnnnnnnnnnnnnnnnnnnnnnnnnnnnnngnnnnnnnnnnc

SEQ ID NO: 237 - DNA, 810 bp, Zea mays
gcacctcttctagtgttaagagcatgtataactggaacaactggcttcagttattcagttatatactactgcctgcactaagaatcctatgagggtgcatgcatttttgctatcaaacaaataatatttagtccacaataataataggaatatccgtactgttttataggtcatcaacgagactgtccgattagccaatattgcgcctggcatcttcagaaaggcactgaaagacatacagttcagaggtgaagatgtccttacacctgcagttttctctgttgagcaaactgatcgcactctaaaacaaacatgataaaaatcatagctttgatgtcactataaagtgcttttgacgtgtgatcttgaacagggttcacaattccagctggatggggagtgatggtctgtcctccagcagtgcacttgaacccagtcatttacccagatcctcttatctttaaccctacaaggttcaaggtttgtggattcagtccatgtatgcagaagtacacatgcagtgatatctggtgaaattgtttttgcacatgtccacatacaggataaaccggagataaaccgtgggtcaagacacttcatggcattcggaggaggcctccgatcctgtgttggagcagacttcagcaagttgcaaatgtctattttcctccatttccttgtcactagatacaggtagaattttcacaagcttatttctccgggagtcagaactcagtttaaaaaaatccatattcattttccaatatcatcgccctttaatttctttcacatcatttcaggtggagaagt

SEQ ID NO: 238 - DNA, 773 bp, Zea mays
ataccttataaacttctctcaggtattctcccagtttcatacaagctatgtaatttgatttctgccttgattcagccttccaactccagctgcaaattgaaaagcgtccagccaatgatatgtgtagcctttcaactccagccgataacttaagaagtcattgccctaaaatgctgatatagaactagcagtttggccatatttgtctgacaatggagaatcgctttgttctgttactctgtgaaaacagtttgacacttggtcgctaaggtccgctaaatctttgttgattgtttcactgttatctgctacggtagtttagaggatttccatttcctccaaatctaaccttgctacaagtatgatctgctaataggctttttaccgccctttggtcactgtatacttttcaatgcaggtggatgtaattagaacaaagttcgaggataacatcaaagatctctatattttgcattcgaaatcttcaaaatatacggagcttggcctttcccgtttctgggggtatctgaactacaatgagtatcattctacgaaagtcagcaaagatatggacaacttctatttttgataggacattgcaagactgaagtaaggtttgcctttatatttgggcaatagctcactggccaccgggactagcttaccttttgaggtacacactgctgagtggtgagagttcttgtagatatacgctggtttgatcaaattggcccttgtattggtttttggcgaacttaagagaactatgtcag

SEQ ID NO: 239 - DNA, 669 bp, Zea mays
  misc_feature (226)..(226): n is a, c, g, or t
  misc_feature (254)..(254): n is a, c, g, or t
  misc_feature (289)..(410): n is a, c, g, or t
  misc_feature (552)..(554): n is a, c, g, or t
  misc_feature (566)..(568): n is a, c, g, or t
  misc_feature (570)..(570): n is a, c, g, or t
  misc_feature (575)..(581): n is a, c, g, or t
  misc_feature (584)..(585): n is a, c, g, or t
  misc_feature (589)..(605): n is a, c, g, or t
  misc_feature (608)..(613): n is a, c, g, or t
  misc_feature (617)..(647): n is a, c, g, or t
  misc_feature (656)..(668): n is a, c, g, or t
  unsure (1)..(669): unsure at all n locations
gtaatgtgtgccatcaggagtctatttcactttcctgactttgctgaagactagtagtattacctgaaacattacaagcatggttggaagtgtagtattttttgtagttttgaaacaatagtatttgatgatactatcgtaaggtgtttgtttgtctaggcaaaacacagtcttaaataccatggtttacctaaaaccgtggtattttttagagtttttaaaatcncattcaggacctcagttttcttctcttntctttaaatatactttttttccaacggaaccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgatttgtctgataacactggtcaaaggtgtttggttaccatgcattgacacatgcagatatgaaaagcacgaggggctagcctcaccataaagctagctcaagatcccagaaacccatgtcaatcaatattggaaaaannntgatatgtgcgnnntngcatnnnnnnnttnncacnnnnnnnnnnnnnnnnnaannnnnngcannnnnnnnnnnnnnnnnnnnnnnnnnnnnnnacacacacnnnnnnnnnnnnna

SEQ ID NO: 240 - DNA, 662 bp, Zea mays
  misc_feature (530)..(531): n is a, c, g, or t
  misc_feature (551)..(551): n is a, c, g, or t
  misc_feature (556)..(557): n is a, c, g, or t
  misc_feature (562)..(570): n is a, c, g, or t
  misc_feature (572)..(572): n is a, c, g, or t
  misc_feature (574)..(586): n is a, c, g, or t
  misc_feature (591)..(592): n is a, c, g, or t
  misc_feature (596)..(606): n is a, c, g, or t
  misc_feature (609)..(661): n is a, c, g, or t
  unsure (1)..(662): unsure at all n locations
tgcaacactgatgcctgaatcaccataaggaagcttcacatatgaacagtttggaagtgttggaggggatctagactgagagtgaaggagatagcgctcaatttctgaatcatcatataaacagatgtgaccagatttcaacaagagtgcaagggcactttgtctgtgcttatttgggtcactaagccctgtaacaagttccattccttggcaagattcagcgataggcaaaaccatctttacaattcgcgactcactctcttcattcagaatcagaacctattcataaacaccaagtggaaggttgaacaacgatgcagttcttactgaacagaaacaatcaagatacatcatccatataagtcaacaaactaggaagaaaatacaggctccaacaacgtacagaaaggggcaactttcaaatatttctgggaaatagaaacactttttggccagtctaccttgtcattggtgatatttgaatttgcagatcagccaaccataaaaccattaattccgaattgatattnngaaccagaatcatacagatnataanncacannnnnnnnngnannnnnnnnnnnnngatannaaannnnnnnnnnnacnnnnnnnnnnnnnnnnnnnnnnnnnnnnnnnnnnnnnnnnnnnnnnnnnnnnnt

SEQ ID NO: 241 - DNA, 547 bp, Zea mays
  misc_feature (57)..(57): n is a, c, g, or t
  unsure (1)..(547): unsure at all n locations
tcacttgactctctcattcatgaccttgaggtaaatctgatggtatttctgtttcanttcactttgtgaatttccagggaacgaccgtcacaatttgatgcagttgtaacttgatgccaacacaactcatattttgttggacagttcgtgctagcaagagaggatgaggatgaggaggaggagaagcagctgcagaaggacaggctggctgctgcgataaacgccctcacaaaacggaagagcatgctggagagcgagaaggaaaccatacagcagaaaccggccatggacctgatggctgaaaccaagctattcagggaagatgttttcaagaggagatatagggccaaaagttcagtcatggatatggattagcatttctctttagctgataatacctggtgtaaaaagatatggctgatcgaacctgtttgtaaagagataatcgatccatgtgtaccgccagttatatggtagctggtagctgctctcgtcataaccttcattttgttctgatggtgtctgttaattgtactcttcttgggtg

SEQ ID NO: 242 - DNA, 782 bp, Zea mays
gctgctcgcttgtaatatgaggaggtatctgttccagttgttgaggaccttgtgctgatatctgaccgtgcctacacaaaagggcaaattttagaaatggtaatcccactaaatgcaatttgcactcatactgaatgcatgcctggttctttaatactgcattatctaaacgtacaatgatcatagattaggatccatgtatgctacatcagcatacagcagatatggatcttttgctgaaaaattgcaattatgtcctttatacataagtggaacgtgtcaattgtaatctttcggatgatttctccctgttttgctgtcttcttgcatgctatctttttttatacccttgcatgctgtcttctccttgttctgcaattgtatccttgcatggtgtctttttactttacagtgattttttggctaagcgttaaatcttctgattgagcaggaaaagttgattctgaacacgctgcagttcaacatgtctgttccaacaccttatgtcttcatgaagaggtttctgaaagctgcagatgcagataaacaggtgaaatatcactacactagctcaagctcaagatgcagatgatccgtgttttgtctacttggataaacaaaacacctgtagcagtgatcttttggttttatgattgacactgccccactgttgtatctcgcagcttgagctagcgtcatttttcatgctggagctctgcttggtagaataccaaatgctgaattatcggccttcgcatctggctgctgctgcggtttatact

SEQ ID NO: 243 - DNA, 706 bp, Zea mays
  misc_feature (41)..(41): n is a, c, g, or t
  misc_feature (47)..(47): n is a, c, g, or t
  misc_feature (78)..(78): n is a, c, g, or t
  misc_feature (92)..(96): n is a, c, g, or t
  misc_feature (384)..(411): n is a, c, g, or t
  misc_feature (606)..(608): n is a, c, g, or t
  misc_feature (626)..(629): n is a, c, g, or t
  misc_feature (638)..(644): n is a, c, g, or t
  misc_feature (661)..(662): n is a, c, g, or t
  misc_feature (668)..(672): n is a, c, g, or t
  misc_feature (674)..(674): n is a, c, g, or t
  misc_feature (676)..(678): n is a, c, g, or t
  misc_feature (685)..(686): n is a, c, g, or t
  misc_feature (695)..(695): n is a, c, g, or t
  misc_feature (697)..(698): n is a, c, g, or t
  misc_feature (703)..(705): n is a, c, g, or t
  unsure (1)..(706): unsure at all n locations
cagcaaaacctgttgccgcctctcgtcagaacgctgtcacngctcanctcactcaggaactactacctctagcagcanaaatctcatctcannnnnataactaaacgtccatgtcgacggcatccttgaggactggatggcaggcgcgttccggacgttgatgtcgagcggcagcatccggtactcgatctcgaggtctctcaggaccttgatcatctcctggagcagcagctctctccgctcgaacctcatccccatgtcgtggaagttgatcgtctggcgacaccagatggaggccttcagcttgttcgtgtcgtccacgtcgcgcaggaccaccatggagccagggtaccagtgctccttcttgttgtcaaggtaactggnnnnnnnnnnnnnnnnnnnnnnnnnnnnctagtacattaggtatgtatttttgggaaattcatatagggttaaaaggcatcaatcagtacttactgcatcagtctctccttcatgagggacagtttctccaccggcgttgcgacatgaacagtgaagtccaccgaatctcccatgtcaggactcctgtagtaattcatgatcggtagctgggctagcttactnnntggatagtacaccttgannnngtcatatcnnnnnnngatcgtcgtcatgatgnncatctnnnnnangnnnacctgannatgatgcgnannactcnnna

SEQ ID NO: 244 - DNA, 782 bp, Zea mays
tttgcatgcctgcagactctaattatcaggaacaggtcgaaacggtttgttcttgggccgaatgcttcacggatggaaattgggctgtaagtggactcttctggtatcgtgcgcgatctaatagtgtttctgggcctttaccagccttcgtgtggttaccttaaaatccaagtctttcctgggaatcttgttttctttaggaagactagcaaatatgcttgtgggcttatagcgcgcgagaggaagaaaaaaaaactatcgaacattcatacaacataacaactatatttgttatttttggttcgctagtttgttctgtgagtgtgttgtgtagctcgctgctgctatcctactacgttcttgagtggaatcaaacttagatacatagtaactaaaacaaagtttagatacatagaaacttgcttatcatggaatttcggctcttgaatatcgagaaaaggtaaagttaggagccaagagatccctgatgttgcagaaccaaaccaaaacagagctaattacagtcgaggccagacagtcgcaaggcgacagacgtggtaggccgtgggcgtgatctggacactcatcggtgatgaacaatagcgcacgggaggggagttacgttcatggcatgtagacagggctgaaagtttaaagcctcgtttggtttatgaaagtggacttagtggagtggcatggggtgtcttttttttttggaattatttctggtgggttgggcgttgcatgacgatgcgtcgctcgaatcgatgcgggcatgcgct

SEQ ID NO: 245 - DNA, 530 bp, Zea mays
  misc_feature (282)..(282): n is a, c, g, or t
  misc_feature (311)..(311): n is a, c, g, or t
  misc_feature (444)..(444): n is a, c, g, or t
  unsure (1)..(530): unsure at all n locations
ttgcactactccattgtggggcttctgtacgaacaatccgcttcaacagaggcactgctccagcagcaattattgctgggtgattctctggatccatgctcagattatataagatagataagatagcctccagtgcatctccatccgcctcttcaagcattttcaccagtggaaatatgcctccagaatctgccactgctcttgtatattccagcacaccaccagatattatcttgttgagctctattacagcacttcttttattttcaaacgaaagtgatntcatcatttgctcaattagccttggaatngtctcatagatagttatctccatatctatactactaacaccatgatctcctgataagccagctctggattctagcttaatgaggcatgccgcaagacaatcctttgactgaagggggaaatttgatttgagcnttcttcttagcaaagaagtgattttttcaccgtttatgctgcggatgaaaagatcaaagttcaataactttgagagtaacctcaca

SEQ ID NO: 246 - DNA, 699 bp, Zea mays
  misc_feature (42)..(42): n is a, c, g, or t
  misc_feature (169)..(169): n is a, c, g, or t
  misc_feature (240)..(240): n is a, c, g, or t
  misc_feature (269)..(269): n is a, c, g, or t
  misc_feature (282)..(282): n is a, c, g, or t
  misc_feature (385)..(385): n is a, c, g, or t
  misc_feature (556)..(574): n is a, c, g, or t
  misc_feature (579)..(582): n is a, c, g, or t
  misc_feature (584)..(590): n is a, c, g, or t
  misc_feature (593)..(595): n is a, c, g, or t
  misc_feature (606)..(613): n is a, c, g, or t
  misc_feature (619)..(644): n is a, c, g, or t
  misc_feature (656)..(674): n is a, c, g, or t
  misc_feature (676)..(684): n is a, c, g, or t
  misc_feature (686)..(697): n is a, c, g, or t
  unsure (1)..(699): unsure at all n locations
tttaagcataactgaatttgaacttgtttcattttgccttcntctagatcatgttgtgacaaaatgtaaaataagacatcagtgtttttagttgccaatgggggtcaagttttttcctttctcattctattcgttattttatatgtctagctttcaatatgtagaatantgtgtgaatatacatggcaataagttcaagtgaatttgctatatttgacaatttacatacattccttattntttgttgtattcttagctgccactctacnatgaatttatagntggaggataacctgtggtcatgctatgacagtttattttttagagcgggcttgcaatagctcagccaaatgacgtggatagctgtaaatcatgctttgcaatntggaatgagatattacatgtttcattactgctatttgcaaagtgtaacttcgtttgcacttgttcagcatcttgccaactattttttagatcctgatatttcattttgactaacatcgtcagtataaatactattgtatcatgatttcatgttttcttttctcaagttttnnnnnnnnnnnnnnnnnnnaacannnnannnnnnntgnnnattttgcactnnnnnnnncttacnnnnnnnnnnnnnnnnnnnnnnnnnnatttttcatatnnnnnnnnnnnnnnnnnnncnnnnnnnnnannnnnnnnnnnntg

SEQ ID NO: 247 - DNA, 485 bp, Zea mays
  misc_feature (279)..(279): n is a, c, g, or t
  unsure (1)..(485): unsure at all n locations
catgggtacaaaaaggctcccatttcccagtagggtgtttgatgttgttcattgtgcacgatgtagggtaccgtggcatattgaaggtactttctatcacgagaatcctgctctagcacaatacagtccctttgtgttagctgcttctgtgacactatgcctgttagttatttggcaggcggtaaactcttgcttgaactggacagactgttacgtcctggtggttactttgtgtggtctgctacacccgtataccagaagctgcctgaagatgttganatatggcaaggtattccatgctttaatttcttctctacagttattacagtgaattacgaatttcatgccccaagagttatctttgttctgccttgctgtagccatgtctgctctaaccagttcaatgtgctggaaaatggtcaacaaagtaaaggatagggtgaatagagtgggtatagcaatttacagaaagccaacagacaaca

SEQ ID NO: 248 - DNA, 485 bp, Zea mays; identical to SEQ ID NO: 247
  misc_feature (279)..(279): n is a, c, g, or t
  unsure (1)..(485): unsure at all n locations

SEQ ID NO: 249 - DNA, 625 bp, Zea mays
  misc_feature (388)..(389): n is a, c, g, or t
  misc_feature (499)..(499): n is a, c, g, or t
  misc_feature (510)..(512): n is a, c, g, or t
  misc_feature (537)..(540): n is a, c, g, or t
  misc_feature (544)..(549): n is a, c, g, or t
  misc_feature (551)..(551): n is a, c, g, or t
  misc_feature (554)..(554): n is a, c, g, or t
  misc_feature (560)..(571): n is a, c, g, or t
  misc_feature (581)..(596): n is a, c, g, or t
  misc_feature (598)..(605): n is a, c, g, or t
  misc_feature (607)..(623): n is a, c, g, or t
  unsure (1)..(625): unsure at all n locations
ggccttcttttttggctttaatctctcacaaggcaacttttttgacgaatgtgtaggacacagcataacaaagttctcctggagcaaatcacatttgttcagtgatatggtcaacaaatactttaccacaaaagggcacgcactttttgtttaatacacaatggacagtgcagatttaaggaacaatacttacttgatcccatttgcagcctttgatgttgtaggcacatgggacatgaaaacttttgcggcagctcttcacaaggcagccaagtgctgcgccttttaagccacaaacactgcatttgatcttagaagcacgggccaactcaggccccaagttgtttgcggtgtcaccagtaaagaatgcttgaggagccctgtattnntattataacttagtgcagcaagttttattttggaaatagtacactaaatgatcactacacaggtacagaatgcaaaaaaaatcaaactttgcacctaaaaagaaccaganaacacaaactnnntgtctcagaatatggagtatgtgtnnnnatcnnnnnnangangtatgnnnnnnnnnnnnttatcatgannnnnnnnnnnnnnnnannnnnnnntnnnnnnnnnnnnnnnnngc

SEQ ID NO: 250 - DNA, 1183 bp, Zea mays
  misc_feature (102)..(102): n is a, c, g, or t
  misc_feature (199)..(199): n is a, c, g, or t
  misc_feature (203)..(203): n is a, c, g, or t
  misc_feature (210)..(211): n is a, c, g, or t
  misc_feature (234)..(234): n is a, c, g, or t
  misc_feature (242)..(245): n is a, c, g, or t
  misc_feature (247)..(247): n is a, c, g, or t
  misc_feature (249)..(250): n is a, c, g, or t
  misc_feature (514)..(514): n is a, c, g, or t
  misc_feature (577)..(577): n is a, c, g, or t
  misc_feature (579)..(582): n is a, c, g, or t
  misc_feature (586)..(587): n is a, c, g, or t
  misc_feature (615)..(619): n is a, c, g, or t
  misc_feature (627)..(635): n is a, c, g, or t
  misc_feature (645)..(645): n is a, c, g, or t
  misc_feature (647)..(647): n is a, c, g, or t
  misc_feature (649)..(649): n is a, c, g, or t
  misc_feature (712)..(715): n is a, c, g, or t
  misc_feature (762)..(762): n is a, c, g, or t
  misc_feature (771)..(774): n is a, c, g, or t
  misc_feature (787)..(788): n is a, c, g, or t
  misc_feature (792)..(792): n is a, c, g, or t
  misc_feature (797)..(797): n is a, c, g, or t
  misc_feature (837)..(841): n is a, c, g, or t
  misc_feature (899)..(899): n is a, c, g, or t
  misc_feature (925)..(925): n is a, c, g, or t
  misc_feature (929)..(933): n is a, c, g, or t
  misc_feature (1164)..(1166): n is a, c, g, or t
  misc_feature (1174)..(1176): n is a, c, g, or t
  unsure (1)..(1183): unsure at all n locations
aaaggagtgacgggcacgtcggcgtggcaggtggcgcggcgccattgggcggggccgccgatcgacgacctgcgtgcgcgcgcggcgggagaggctgttacnaaaacagagaagctcacatcggccaagtggtttcgccatctccgccgcccctggatcactcggtgctctcctctcctactctcccattcagattctntaanaaaaaanngtctagatctagcgagatcgtgntgtagtannnntngnnttgcttggcgcatcgttgtttgttaacattacatgcttactgttgcccgtgtgcgtgtatcaccactgtatccatccatccatgtttgtttctgcatgaaacggtgcgtgcgcgcgtgttgtcccgggtgtagaaggctgccgcgcgctctggacgaagcaggctcatctcgtgctccagtgcggcagtgcaatgcaaaaactgcaaggccaacctgaagccttgaaaccatggggccggcaaggcggcaaggcatcggcacgnccgaaagttgatggatcatgcgtctcgcgtctcatgtgtattattcgcatggcgaaatcgccncnnnngtgnntatatataattatttatttacgcactgnnnnncgaccgannnnnnnnncgtgcgtgtngncnggtagggggggtggcaaacgctttggcgcgtggtccggtgctcggttgcttaccagctagagnnnnaaaggtgagacgctgttgtttttagatgcatgccttttgcgtgcagnggagagcgnnnnaaggatagctagnnaganggccnctccattgcctgtagtgcagggtgttcatggctgctggtnnnnntggtcatacagtatgatcgacgacggcgagacacattcatttggtagaacatacgccncccgccccgataagaaaaaaaaaaancgcnnnnntaggttgccgagaatgcacgccttcaggttgtactccctccgtttctttttatttgtcactggatagtgtaattttgcactatccagcgacaaataaaaagaaacggagggagtataaattattaatgctatataggacatggagttcagagttttttatttcaaagaaaaaatcagagagataaagagagagagcgctgctgatctgtatatagaaagtagctaggtcgnnncttcctannncctacta

SEQ ID NO: 251 - DNA, 332 bp, Zea mays
  misc_feature (323)..(326): n is a, c, g, or t
  unsure (1)..(332): unsure at all n locations
aagcttcttttcgattacgtgaacatggcagtggtcgagattggccatgacaccttactatgcgcctacccctggaggcagccgtgctccatggcctgggaggagaccctctatcaagctttggcggaggaagtgccacgccatatgagggattggctccatgggtcaggaaagtttgcaggaaacgagaacgacgacgccggaacgttgttggagagaatcatgcggcaggaggtggaagggagaggctgggtgaagtccatgagatgggagttggatgagatcacagagcagattgcaggaaaggtgctggatgaaatagnnnnagaagc

SEQ ID NO: 252 - DNA, 603 bp, Zea mays
  misc_feature (8)..(11): n is a, c, g, or t
  misc_feature (56)..(56): n is a, c, g, or t
  misc_feature (258)..(258): n is a, c, g, or t
  misc_feature (270)..(270): n is a, c, g, or t
  misc_feature (349)..(349): n is a, c, g, or t
  misc_feature (538)..(544): n is a, c, g, or t
  misc_feature (547)..(550): n is a, c, g, or t
  misc_feature (552)..(554): n is a, c, g, or t
  misc_feature (556)..(556): n is a, c, g, or t
  misc_feature (563)..(600): n is a, c, g, or t
  unsure (1)..(603): unsure at all n locations
tgcctgcnnnnaaggtgatggttcgcatataattaatgactgacgagcttagaaanaaagggataccttttaaatgtataagcccaccattaatctttggacaacgctcgaggtctaagtttaccaaattaactaagtttgcaaaggcttttgctccttcagcagtaacagcagcacatttcttaatgctcagtgatgtcaagtttgaaaagcctacaaagttaggagattattgtggcagagtaacaaaaataaganctctaatactanactaagttgacacaacaatatcatacagctgacagcaaactcagctgttgtgctatcagcgtaacactgacctgataangtcttaagtccatgttctgagatttgatcacaataatcacatgccaaactttgcatgcttgagcaatctttaagaagattgaatccactatcagtgacatccgagcaagagaggtcaacagatagcaaggactgcccttgagaagccactacttccatccaagcatcagtaactccagggtagtctccnnnnnnnatnnnntnnnangagatgnnnnnnnnnnnnnnnnnnnnnnnnnnnnnnnnnnnnnnatg

SEQ ID NO: 253 - DNA, 501 bp, Zea mays
  misc_feature (3)..(4): n is a, c, g, or t
  misc_feature (6)..(6): n is a, c, g, or t
  misc_feature (11)..(11): n is a, c, g, or t
  misc_feature (24)..(24): n is a, c, g, or t
  misc_feature (27)..(27): n is a, c, g, or t
  misc_feature (35)..(35): n is a, c, g, or t
  misc_feature (45)..(45): n is a, c, g, or t
  misc_feature (52)..(52): n is a, c, g, or t
  misc_feature (59)..(59): n is a, c, g, or t
  misc_feature (63)..(63): n is a, c, g, or t
  misc_feature (80)..(89): n is a, c, g, or t
  misc_feature (110)..(110): n is a, c, g, or t
  misc_feature (272)..(272): n is a, c, g, or t
  misc_feature (294)..(294): n is a, c, g, or t
  misc_feature (393)..(393): n is a, c, g, or t
  unsure (1)..(501): unsure at all n locations
gtnncngattntgcacacgtacgnacngatccacnccgccaccgnggacccnggccggntccncactgtcattttcagtnnnnnnnnnnggtcaacacgtggttttaggntctcaaggttgaactattgcaaagaaccaaagaacaattgtcattctgctcttgcacagatgcgcgaacggctccatcctccaggcacaaagtcatggccaggacccaggtacaagcattaggcaaggtaaatgaccggtcagtcagcactgaagcatacanccaaatgggagctccaggctgnacaaaatctaagcacctcaaacaatttgaagttcacctagacaccacgctaacagagcgacattattatttctaacaacccacatgaatacatgctaantctcagggttcgctcttggcagcatggctgtctgatgcacctgcgttctgagcatgtgatgacagagaaaatcctctcatctttaggtccaccggaaatggatgcgcc

SEQ ID NO: 254 - DNA, 356 bp, Zea mays
ctctttggtccattggagtttctggtaatcttttctcatggtttttccaaccaactacagcttacaaagataacttgcatgttttaatgttgttgctaatgtgaacctatcaatagtagtgtttaaatagttttatcaactagagaagtatcctaagactacgctaaagattttttttgatgtaagaactatgctaaaggttgccttcccaatcccgcattacttttatttcagaaattgacatcaagcgcattcatttctatgcccaaatcatcagctaatcctcgcaggcacagaccaccctcagcttttatagaacgccccaattgatatgaatagatttctggatttaggag

SEQ ID NO: 255 - DNA, 311 bp, Zea mays
  misc_feature (19)..(21): n is a, c, g, or t
  misc_feature (23)..(24): n is a, c, g, or t
  misc_feature (31)..(36): n is a, c, g, or t
  misc_feature (39)..(40): n is a, c, g, or t
  misc_feature (42)..(44): n is a, c, g, or t
  misc_feature (80)..(81): n is a, c, g, or t
  misc_feature (131)..(131): n is a, c, g, or t
  misc_feature (136)..(137): n is a, c, g, or t
  misc_feature (227)..(227): n is a, c, g, or t
  misc_feature (268)..(269): n is a, c, g, or t
  misc_feature (286)..(288): n is a, c, g, or t
  misc_feature (296)..(300): n is a, c, g, or t
  misc_feature (303)..(303): n is a, c, g, or t
  unsure (1)..(311): unsure at all n locations
acttgaagaagatctaccnnntnnagagccnnnnnnacnntnnnctaaaagaaatttgaagaaaagacacctaaatggcnncttggtcaaaacaaacaatctccatcgacatcaagagcagtaccattccngtatnncaacatgcgacaaacacataggacccaaagaaacagttgaatttaaggatgtttatgaagtcagtgaagaaccattgagaacataccatnttcaggaccaaacttttcctagggaaatgtcttccaggagnnagagagacataaggatnnnaattgttnnnnngangttcatga

SEQ ID NO: 256 - DNA, 514 bp, Zea mays
  misc_feature (113)..(113): n is a, c, g, or t
  misc_feature (256)..(256): n is a, c, g, or t
  unsure (1)..(514): unsure at all n locations
ttcattatcatgggtttcaatgatgtcagttacatacacaccctggttgtccttagttgtgtgactatccagcccatgagtagaacaattagtttttcgtattttaggagtcngtatctgagaagacttgcctttctgctctacttccccaacagtgcttaaaggagtgtcaactacataacctccctgaaccaaattttcttctgcatcatttgtttccttcaatgccaatgtatcacatacctgcttaacagancccttcttcctttgacgcttagtggttttgcgcttatcatcagcttgtgcaaccacatttccagttactatatcctcaggatcacttgttttatcagcaaacctcaaagaatcagattctgttaattctctattagcatcttcttcggatacaccacttgattgatgagaagagtcagtcatggttgatagcactttcgattttttccccttagacttcttttgtctaggtgagctaacaggagaagcaaagtgaacc

SEQ ID NO: 257 - DNA, 741 bp, Zea mays
  misc_feature (589)..(589): n is a, c, g, or t
  misc_feature (595)..(595): n is a, c, g, or t
  misc_feature (597)..(597): n is a, c, g, or t
  misc_feature (606)..(609): n is a, c, g, or t
  misc_feature (616)..(622): n is a, c, g, or t
  misc_feature (624)..(634): n is a, c, g, or t
  misc_feature (637)..(637): n is a, c, g, or t
  misc_feature (641)..(643): n is a, c, g, or t
  misc_feature (647)..(647): n is a, c, g, or t
  misc_feature (651)..(656): n is a, c, g, or t
  misc_feature (665)..(665): n is a, c, g, or t
  misc_feature (668)..(669): n is a, c, g, or t
  misc_feature (675)..(679): n is a, c, g, or t
  misc_feature (681)..(681): n is a, c, g, or t
  misc_feature (683)..(686): n is a, c, g, or t
  misc_feature (688)..(695): n is a, c, g, or t
  misc_feature (697)..(712): n is a, c, g, or t
  misc_feature (714)..(714): n is a, c, g, or t
  misc_feature (717)..(736): n is a, c, g, or t
  misc_feature (738)..(740): n is a, c, g, or t
  unsure (1)..(741): unsure at all n locations
atgctgcaaaagcttgagcttgctaggaagcacatcataagctcaatgttcgcagtggaccaaagacttgtttgttcaacatgtgctggattgtattatagcattttacaacgccatagcatttcctgacaaagcagtgaatacaagttgccagttccatgattagcagcattggcaataagggccaggtgacactagcattttatgcaccagtggcccttaacaaagttgcaggcctttgtcaacagtgctttcagtcaatctgtgatgaatacccgtaaacattaaggatggattaaaaaggcatacttgatgttttgaaggctttgaacaatagtaagtggagtctcctttcaatctggttagattacaagtcatcttgtttattttttttgtttctatgttccctacagtcataatcttctactccctctattatgaattgtaagccgttttggtttattaggcgcatatcttttgatatgtatctaggatatacaatttcatctaggtatagagtagaacttatgaatctatatatcaaaaaatgtatatgctatctaacacgtttaatcaagatagtatatgngtagangntcatggatnnnnatagcannnnnnncnnnnnnnnnnnaantagnnncctnaaannnnnnatactactncanntgaaannnnnangnnnnannnnnnnncnnnnnnnnnnnnnnnngnggnnnnnnnnnnnnnnnnnnnntnnnc

SEQ ID NO: 258 - DNA, 339 bp, Zea mays
  misc_feature (335)..(335): n is a, c, g, or t
  unsure (1)..(339): unsure at all n locations
tgagcttagtccctatgtgtccgagtttgtgcttcttgaatccaactcaacctttactggcataaaaaagcccctccacttcaaggaaaacaagcaccgttttgggttcgctaaatcacggctgacatatggtaatattgggggaaggttcgtgaagggggagaacccatttgttgaggagtcatatcagagggttgccctggaccggcttcttaagcttgcaagaatagaagacgatgacctgctgatcatgtcggacgttgatgaaatcccgagcggccacacaattgatctcttaaggtggtgcgacggcattccagacatacttcaccttnagct

SEQ ID NO: 259 - DNA, 694 bp, Zea mays
  misc_feature (43)..(43): n is a, c, g, or t
  misc_feature (67)..(67): n is a, c, g, or t
  misc_feature (100)..(100): n is a, c, g, or t
  misc_feature (102)..(102): n is a, c, g, or t
  misc_feature (175)..(175): n is a, c, g, or t
  misc_feature (262)..(262): n is a, c, g, or t
  misc_feature (538)..(538): n is a, c, g, or t
  unsure (1)..(694): unsure at all n locations
tacccctggtgctctcttctgcctgtaaattagctcgccgggnttgcgatgccttaacgcgtgtccngctgtcttactgtagctgtagccagtaggtagnanagtttcgttacactgatgcagtgtaggctgtggtgaatgacgtcagaaactacgcgtgttctgttaaaaaaanttactgcaggtctgtgcataaattgggttggattggcaaatcgggtgactgactgtttgcagcttactgagaggtttcttactcctntatggaaagagtttgccaatttccccaagacgaagacaagtgggatacgcgccggcgcgcgtatgcgatctacctcgtctgggctgtgttgactgtgggaaacgcgtgcaaaagtggcagcggcagcacgcgctgtggggctcatgggctgcggccgagggcgcccatcgggcccatacatgtgtaggctcgccgaacggaagaacaagcataggcccaccctcggatatgcgcccagttttacactaaaattatttccgtttttatatttttttncggaatcaaaaatgaaaatgataacttcgaagaccataacgacatcaagcgaaagctcagtaaaaaataccccaattacggtcgaaatctgacatacggtcggtaaaaatcgtggcggggcttggctggcttattgtagctaaaaacacggtacca

SEQ ID NO: 260 - DNA, 376 bp, Zea mays
  misc_feature (93)..(93): n is a, c, g, or t
  misc_feature (116)..(116): n is a, c, g, or t
  misc_feature (134)..(134): n is a, c, g, or t
  misc_feature (145)..(145): n is a, c, g, or t
  misc_feature (164)..(171): n is a, c, g, or t
  misc_feature (227)..(227): n is a, c, g, or t
  misc_feature (233)..(233): n is a, c, g, or t
  misc_feature (270)..(275): n is a, c, g, or t
  unsure (1)..(376): unsure at all n locations
ataagtgtgtaacatgactcagtcgggtaaaatgacacattcaatcccaaagcatcaaagggaaaggttcatttgtgatctgaacaaattttncttcacatgcagtgcagaaacancatgccagttggattagntgggtatttcnagaacaacttgggtccaannnnnnnngatgtcaagcacacacttttaaagttgggacatcaattctaagctgatacatcccntgttcncgagacattccttgccgacttccggttgacaaaaaannnnnntccaaactactgaatgctcacctcaaacaagtgatccaagaaaaagtgggagagcgagccggcagagatcagcaagaaacactgcctctttcttaatggta

SEQ ID NO: 261 - DNA, 683 bp, Zea mays
  misc_feature (3)..(3): n is a, c, g, or t
  misc_feature (185)..(185): n is a, c, g, or t
  misc_feature (241)..(241): n is a, c, g, or t
  misc_feature (244)..(244): n is a, c, g, or t
  misc_feature (272)..(272): n is a, c, g, or t
  misc_feature (286)..(292): n is a, c, g, or t
  misc_feature (309)..(309): n is a, c, g, or t
  misc_feature (311)..(311): n is a, c, g, or t
  misc_feature (371)..(371): n is a, c, g, or t
  misc_feature (410)..(410): n is a, c, g, or t
  misc_feature (415)..(415): n is a, c, g, or t
  misc_feature (427)..(427): n is a, c, g, or t
  misc_feature (480)..(481): n is a, c, g, or t
  misc_feature (485)..(485): n is a, c, g, or t
  misc_feature (508)..(508): n is a, c, g, or t
  misc_feature (530)..(530): n is a, c, g, or t
  misc_feature (536)..(536): n is a, c, g, or t
  misc_feature (597)..(597): n is a, c, g, or t
  misc_feature (600)..(601): n is a, c, g, or t
  misc_feature (603)..(610): n is a, c, g, or t
  misc_feature (625)..(631): n is a, c, g, or t
  misc_feature (635)..(637): n is a, c, g, or t
  misc_feature (640)..(641): n is a, c, g, or t
  misc_feature (644)..(644): n is a, c, g, or t
  misc_feature (648)..(657): n is a, c, g, or t
  misc_feature (673)..(673): n is a, c, g, or t
  misc_feature (677)..(677): n is a, c, g, or t
  misc_feature (681)..(682): n is a, c, g, or t
  unsure (1)..(683): unsure at all n locations
tcntgaatgttgttcatgtaggtgttggcccaatcagtcagcatgacattgatctggcacaagcatgtggagcatatatagttggtttcaacattcgcagtccacctagtcctatcactcaagcagcagcaagagccaacataaaggtaccatgttcatgaatcactacttctctaatgctagtngtgattatatggttcaagaaactttgttttgtttctttgagttctatgttatcatngantttcagactttcagcgcatctttggctnaatgttccattttnnnnnnnggaaactcttggttttntncacagatgctagaatctagaccatccatgctctgtttttcttttgtcatggtaaaccaantgaacctttatatttagatgttatggaatcctttgggangatgntattaagaattntctctgactcgggggaatgaggatataactaccattggattgaacacagcaanncggnctgtagattcaaaactccagtanttaatacagacgtgatgatatnatggcntgttccttttttctttttggtatgcaaatcgatagaacttcagttcatgcgtggaaattgnttnntnnnnnnnnataatagcccgagcnnnnnnnctgnnngcnnctngctnnnnnnnnnnagcacctcatatgcanttantctnnc

SEQ ID NO: 262 - DNA, 649 bp, Zea mays
  misc_feature (539)..(539): n is a, c, g, or t
  misc_feature (575)..(578): n is a, c, g, or t
  misc_feature (598)..(603): n is a, c, g, or t
  misc_feature (612)..(619): n is a, c, g, or t
  misc_feature (629)..(636): n is a, c, g, or t
  unsure (1)..(649): unsure at all n locations
tgtaaaataattgccacttggtcatgctaataggaccaacttcaaggtttaagggcaattcctccacagtctcgttgagcgctattaatttatccttcaatagccaaaactcattgaagaatactgtaggataataatcgcccgtaactggatccacattcagatctgtcaagctattgtaaaggaaaaccaaaaccattctcaaaacatgtaacttttctatattccagctttcaacattagttggattcaaagttcaaacaatgaaatttttgaagaaaaaaacagtaagccagtaagaacaatatctatgctgtaagtgtaaaagtggaactattcaactatcacaaaacaaaaatgatatatgttactatctgttacaatttaaggatacatggagcaacaatgggaggtacattattgttgggatacctgtaaaatgtgaacggggcaatgtcaatcatatgcagagacgatggacagattaaagaggacgcataacatagagaagatgtacagagcaaagaggagacagcgtngagaggatgtacagaacaacaagaacacataaacannnnagctgatgctatatacaacnnnnnnaacaacaannnnnnnncatatgatcnnnnnnnncatatgctaaaaa

SEQ ID NO: 263 - DNA, 561 bp, Zea mays
  misc_feature (2)..(3): n is a, c, g, or t
  misc_feature (5)..(8): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (36)..(36): n is a, c, g, or t
  misc_feature (38)..(57): n is a, c, g, or t
  misc_feature (65)..(68): n is a, c, g, or t
  misc_feature (99)..(99): n is a, c, g, or t
  misc_feature (104)..(104): n is a, c, g, or t
  misc_feature (110)..(111): n is a, c, g, or t
  misc_feature (116)..(116): n is a, c, g, or t
  misc_feature (118)..(119): n is a, c, g, or t
  misc_feature (142)..(142): n is a, c, g, or t
  misc_feature (156)..(156): n is a, c, g, or t
  misc_feature (159)..(159): n is a, c, g, or t
  misc_feature (173)..(174): n is a, c, g, or t
  misc_feature (251)..(251): n is a, c, g, or t
  misc_feature (268)..(269): n is a, c, g, or t
  misc_feature (319)..(319): n is a, c, g, or t
  misc_feature (416)..(421): n is a, c, g, or t
  misc_feature (461)..(461): n is a, c, g, or t
  misc_feature (468)..(493): n is a, c, g, or t
  misc_feature (512)..(512): n is a, c, g, or t
  misc_feature (514)..(514): n is a, c, g, or t
  misc_feature (520)..(521): n is a, c, g, or t
  misc_feature (537)..(538): n is a, c, g, or t
  misc_feature (555)..(556): n is a, c, g, or t
  unsure (1)..(561): unsure at all n locations
cnngnnnncactgttcagggttttttttntntnttntnnnnnnnnnnnnnnnnnnnnacagtttnnnngtttcaactaaaaacggattaagaacaccgnatctnctttannacttngnngtggtaaccaataatacgagttntccatggacgagcntgncccccagcatatanngctctcaccttttcttttttcttccatgccaatcaaagacaagccccacttggcatgcaaatctccatcagtacagncccttgcccacacacannaactctaccagtctaggagtaacggaagattttcttacctctacgccacnctctcgcccttatcttcgttcatctcttttctttgggagattgagagagggaaaaaaaaagacgacaaaagcatcggcctctcgtaaagacagagannnnnngacatcatcgcgaaagggacgggacacgaactgccggccnaaaaatnnnnnnnnnnnnnnnnnnnnnnnnnnagtgggcggatgtgacccngngggggnngttggagaaaggcctnngcgcgccacacgtaacnngccca

SEQ ID NO: 264 - DNA, 718 bp, Zea mays
  misc_feature (198)..(198): n is a, c, g, or t
  misc_feature (380)..(380): n is a, c, g, or t
  misc_feature (439)..(439): n is a, c, g, or t
  misc_feature (618)..(618): n is a, c, g, or t
  misc_feature (630)..(631): n is a, c, g, or t
  misc_feature (647)..(652): n is a, c, g, or t
  misc_feature (654)..(654): n is a, c, g, or t
  misc_feature (656)..(658): n is a, c, g, or t
  misc_feature (663)..(663): n is a, c, g, or t
  misc_feature (665)..(682): n is a, c, g, or t
  misc_feature (689)..(694): n is a, c, g, or t
  misc_feature (698)..(698): n is a, c, g, or t
  misc_feature (702)..(717): n is a, c, g, or t
  unsure (1)..(718): unsure at all n locations
tgatgccgtgtgttactgtttaatttgggcttgcaaatttttaaacaagggacaatcacaccttgttttttttctaactaaatattccaataataaatataatgatgtacaatggcccattgggatctctctcggtctttcccacatattctctttactactctgtattcttgtttgtcgtgtttccaatttctcaantttttcgtcaactttgcatattttgttagtattgtgaattctgaattctgatactgtattgtatatcaacattcaccagataatggttgccaaatacttggaaaatggtatgttatttagcttagaagggcaagcctggtgcaatggtagagctgtctcattgaatcaccatgtcgcggttngaagcagcctctcctcatttgtgggggaaggcttgcttctgtttattccttcctcagancccactcatatgggagcctccggcactgggtctaccccttttttatttagcctgctatcttgcacctttgcatttccatactaatgctaaaattgcctagtgacttcctcctttttatttagcctgctatcttgcacatttgcattttcatactaatgctaaaaatgcctagtgactgncttcctttgctnnactcaagcttgctcgnnnnnntngnnnaatgngnnnnnnnnnnnnnnnnnntaacatnnnnnnactngatnnnnnnnnnnnnnnnnc

SEQ ID NO: 265 - DNA, 470 bp, Zea mays
  misc_feature (1)..(1): n is a, c, g, or t
  misc_feature (67)..(67): n is a, c, g, or t
  misc_feature (171)..(171): n is a, c, g, or t
  unsure (1)..(470): unsure at all n locations
ntttttggtgagatcatccactgttttcattgctgatgaaataatttcttgtgagtgcttccctcanttagtctatccttaatccttttggtattcagaatgcgtaaaattattgcgttttaaatttcatgattcctggtgaactctgacttccagcaaataaacttctgngttgatacgtggaaatggtttctgtccttggattacttatataagatgtctagattaacatagtctgttagttagctgaggctcctttgaaatacaaaattttacttgcaacttgaattgttttgtagaggtgcttgcatcctaaatgtcctatggtcttgcattagctgaatgtcaaatttgttttgagagcaccctttcatcttgttataatatcaaaatttaaatttggaccacactatgttaaattctatcaagttaatttagctctacttgaccttttgtaagaacttatagca

SEQ ID NO: 266 - DNA, 649 bp, Zea mays
  misc_feature (125)..(125): n is a, c, g, or t
  misc_feature (355)..(355): n is a, c, g, or t
  misc_feature (479)..(479): n is a, c, g, or t
  unsure (1)..(649): unsure at all n locations
gaagcttttgtacaattaatacaaaagctaatctcccggtagattagccatctttaggtgcaagaagcccaacaagctttcatcactcttcgtgaattcgtcttggctgaggagtatcatcttgnccagcaaagtacaccatgacaaacagaagggcgatgacaaatataaggatgtacagcgagttcaggctgaccagagagttcaggaaacccatgaaagaagggccggtgattttcttctttgttgttcttcctgctctgtatccctcaaggaattggcttatttgagatgcttggtcaccttcttctaatctctctgaaccatccaccttcaccaggaaaattcaatacanaaaataatgaattcttatttaatgattatcagagagacagtagcagtttctatcttaatcaactattaactttttcagggaattatgggggtaaacaaacaggaacctataaaagcaatacctncattgatagaaaaaccgtgccatcactagtaagaaacatgccagtaacgcagtggtttttatatggatgctggtattagaaaatatataattaactactgaggatgctttacttactagctcatactcctcatctctatcccacacaagtagctttggcaggggtaccga

SEQ ID NO: 267 - DNA, 366 bp, Zea mays
  misc_feature (1)..(6): n is a, c, g, or t
  misc_feature (12)..(40): n is a, c, g, or t
  misc_feature (62)..(70): n is a, c, g, or t
  misc_feature (88)..(88): n is a, c, g, or t
  misc_feature (157)..(157): n is a, c, g, or t
  misc_feature (175)..(175): n is a, c, g, or t
  misc_feature (217)..(217): n is a, c, g, or t
  misc_feature (221)..(221): n is a, c, g, or t
  misc_feature (223)..(225): n is a, c, g, or t
  misc_feature (255)..(256): n is a, c, g, or t
  misc_feature (300)..(303): n is a, c, g, or t
  misc_feature (311)..(311): n is a, c, g, or t
  misc_feature (313)..(319): n is a, c, g, or t
  misc_feature (322)..(326): n is a, c, g, or t
  misc_feature (331)..(337): n is a, c, g, or t
  misc_feature (341)..(346): n is a, c, g, or t
  misc_feature (349)..(354): n is a, c, g, or t
  misc_feature (358)..(365): n is a, c, g, or t
  unsure (1)..(366): unsure at all n locations
nnnnnncttccnnnnnnnnnnnnnnnnnnnnnnnnnnnnnaactgaaatcgtattgcgcatnnnnnnnnnaaaacgcaccaaccaccntcctacagaaaacaatttatatcctcctttcacgcagtttttgttaatttatcaatttgttttaggctncctactaatataaaaaanttagcgagaacaaaatttaacagcgagcctacccacttgcangggncnnnatgctttgttggtgttattgtatagaaatnnagtggtaagttattgtgcaacagagataaaccagtgacatactnnnnattttccntnnnnnnnctnnnnngcctnnnnnnnctcnnnnnnacnnnnnnatcnnnnnnnnt

SEQ ID NO: 268 - DNA, 534 bp, Zea mays
  misc_feature (65)..(65): n is a, c, g, or t
  misc_feature (69)..(69): n is a, c, g, or t
  misc_feature (325)..(325): n is a, c, g, or t
  misc_feature (533)..(533): n is a, c, g, or t
  unsure (1)..(534): unsure at all n locations
ctgcagctctggcgacggcctcgctggtgcgacaacagtaaggtgggcgtccacgaacgcctcgntganctgcgcgccgtggtcgttgagcagcacgccgagctcgccgtccgggcccggacggacctggccggcgaatgcccggtacacgcccaacacggcggcgaggccgtgctcaatgtccgcgatggagggcaccggaggtgagaaggcgtagatgatggccatctgtatgtggtatgtgatcttgtcgaacaccgagcaaggcacatgctgggtggtgtctggttgcggcacaccaggtggataggacggcttgacaagnctagagctcatcaccttcacctccatggcgagcgatctgccggcctgtgcaaatggctcacttgctttgctcactcacctcttcgaaataaataaaactctttgaatcttatttatgtgacactacgatactatctatcactagtgcatatgggattgtcctgaacagttttgtttggttgcgcaactgcagtgttgttctcttgttna

SEQ ID NO: 269 - DNA, 414 bp, Zea mays
agcttgttgtccagaacatcggcttactccgcgcgttcaagaagtaaggcaacgagggctctgtccatcttggatttttggtgcctgtaatagacatctctctgtttatagtaactcaattattgagctcaaataagacgagtagttctagcatagtagcacccccacccacacatacagatcataatggctccacacacacacagacacattccatgcatagcttgattaattattctacatttctacttgtagtttgcaccttcttgttctctgcgtcaatgcatacagtctgatctctgtcaacctggttctttctcccttccagtttgcatcttctgtgattgagtgctacctgaatagctcaagatgacagttttagtgtcatcagttaggtgttagttgtgtcatcag

SEQ ID NO: 270 - DNA, 517 bp, Zea mays
  misc_feature (1)..(2): n is a, c, g, or t
  misc_feature (378)..(403): n is a, c, g, or t
  misc_feature (462)..(464): n is a, c, g, or t
  misc_feature (466)..(466): n is a, c, g, or t
  misc_feature (468)..(468): n is a, c, g, or t
  misc_feature (508)..(508): n is a, c, g, or t
  misc_feature (510)..(510): n is a, c, g, or t
  unsure (1)..(517): unsure at all n locations
nnggcatctggtgccagggcgacgctgctgccgcctcgccgtcggtggtgccggacatgtcagcagctaaccaccaccacctcatggttttgcagtacggcaggaggtcgtagcaggcagagacagacagagtaccacccgctcccccccaccgatgtccgatcgatgacactcagttgcaatgtagattctggcatcccctgcccggccctcctaaccctttttgtcggcacggccggcaataggcggcatgacggaacgaccacgagctcccgaccgccagcacgcgcgcacacctggacggcggatgaccggaggcggctgttctcctccacacaagtgctggagagaacataacagcttggaagttgcctggcnnnnnnnnnnnnnnnnnnnnnnnnnngggtcgtgtacgagtgctgatcgaagagtgggtgtggcgcgacttccaagccattttgnnntncnttcagctgacctgatctactaatccccagctgagctgagncnttacatt

SEQ ID NO: 271 - DNA, 648 bp, Zea mays
  misc_feature (236)..(236): n is a, c, g, or t
  misc_feature (437)..(438): n is a, c, g, or t
  misc_feature (451)..(451): n is a, c, g, or t
  misc_feature (456)..(456): n is a, c, g, or t
  misc_feature (492)..(492): n is a, c, g, or t
  misc_feature (495)..(495): n is a, c, g, or t
  misc_feature (499)..(499): n is a, c, g, or t
  misc_feature (503)..(503): n is a, c, g, or t
  misc_feature (517)..(517): n is a, c, g, or t
  misc_feature (541)..(541): n is a, c, g, or t
  misc_feature (568)..(569): n is a, c, g, or t
  misc_feature (602)..(605): n is a, c, g, or t
  misc_feature (616)..(616): n is a, c, g, or t
  misc_feature (634)..(635): n is a, c, g, or t
  misc_feature (645)..(646): n is a, c, g, or t
  unsure (1)..(648): unsure at all n locations
ctacaacgcccagacaaacaagtggtgcctgacgctgatgtctgactcccctgttagtttgcgatagtagcaaatgcattgcattatactcccccacagccacatgagtgagatgcccagacaacctactactactgcatgcatgcatcatgtacggttttatccgagaggaactagatagatagagcaaactaaacgtgcttgcaaaagcacagatctcaaggggcttatgggtncgggcccaaagcgcattattcaaattaccaggcacagatctgagatgcaaaaccgtatgtgtatgtatgtaactatttttcaccgccggccatgtacgcccctcatttgtttaattaaaccagacaccctctcaggctcaagtcaatgctttacagtcctgaaaaacaattacccaagtgccaagcctaccgaacaccccnnacacgattaaaanaaaantaaaatccagaacctttgtcattagtagtagtagtngtntatnatanaagcactaagcagngcagttaacgttgattgattggtnggttgattcttccttctgaaaactgtnnttcagcgagcgagcgagcatgcatgcatgcagnnnncagcatagcangtgcccacacccgtgacnncagtgtgcanntg

SEQ ID NO: 272 - DNA, 755 bp, Zea mays
  misc_feature (165)..(165): n is a, c, g, or t
  misc_feature (171)..(172): n is a, c, g, or t
  misc_feature (232)..(232): n is a, c, g, or t
  misc_feature (283)..(549): n is a, c, g, or t
  misc_feature (635)..(637): n is a, c, g, or t
  misc_feature (643)..(645): n is a, c, g, or t
  misc_feature (647)..(652): n is a, c, g, or t
  misc_feature (655)..(661): n is a, c, g, or t
  misc_feature (664)..(666): n is a, c, g, or t
  misc_feature (677)..(681): n is a, c, g, or t
  misc_feature (701)..(701): n is a, c, g, or t
  misc_feature (708)..(730): n is a, c, g, or t
  misc_feature (734)..(750): n is a, c, g, or t
  unsure (1)..(755): unsure at all n locations
tgcctgcagcatttttttactgcacacacaactcgatctccttagcgtatcgtgtgcggttgttgactgcggccagcctaaggctaagctttccgccggcctgcccagtaaaaaaaactctaagtctgcggtagagtttaaattttataggcgattttagttatngagcgnnagtagtatttttagtagtggttttcttaaataaccatatgtagaaatcgatttatacganaatgcggttttcttaaaaaactgacaaaaaaacatttttagctagattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtcaatttatattcggattgttctaatatgttgccaacaaaactacaatataaatatgaagtaagtgataggtggattggtagnnnggctannngnnnnnntgnnnnnnnttnnncgattcccacnnnnnctacacgtgaattttgagtngaaaatnnnnnnnnnnnnnnnnnnnnnnncgannnnnnnnnnnnnnnnnttttt

SEQ ID NO: 273 - DNA, 715 bp, Zea mays
  misc_feature (28)..(28): n is a, c, g, or t
  misc_feature (31)..(31): n is a, c, g, or t
  misc_feature (177)..(177): n is a, c, g, or t
  misc_feature (185)..(185): n is a, c, g, or t
  misc_feature (376)..(376): n is a, c, g, or t
  misc_feature (427)..(427): n is a, c, g, or t
  misc_feature (630)..(630): n is a, c, g, or t
  misc_feature (636)..(637): n is a, c, g, or t
  misc_feature (639)..(639): n is a, c, g, or t
  misc_feature (674)..(677): n is a, c, g, or t
  misc_feature (679)..(686): n is a, c, g, or t
  misc_feature (695)..(695): n is a, c, g, or t
  misc_feature (700)..(702): n is a, c, g, or t
  misc_feature (705)..(708): n is a, c, g, or t
  misc_feature (713)..(714): n is a, c, g, or t
  unsure (1)..(715): unsure at all n locations
taagataataataattttaattggcacnaanacattgtataagcaatatattctctggcatctcaactaacaattctgaacatgaaaacttaacaaacagaatgaatcaatcaccatctgcgctgaattatgcaaaatgtatttcttttacccaacatattgatattgaaataaacnaagaagcnttgcacaagtaggggaaatttaaacaagcatacacactggcaatttttttggcactggtacatatgccataaactgatagaaatgtctattctacagaaggccacatccaatcatctcttttcagttttcacatagaatcatccatataaaacatatgtttgacaagattaaaattatttatgtcaatttntcgactcccaaaatgatgtcacatagaagctggagaatgcaaaattgatgnttcacgaatatctcacacctttgtaaaatattcaggattgtctgatatgaatgatttgtcactgccatcaaaaggcaacataagaatacactgaaatctataaagaacaaaagtttaagtaaaccaagatcattgtttccaagcaagacatcctcacatcatacaggatcacttttacacagagtaaccttaaaatggctagnctctgnncngtgtgtacttgtgtacgattgaaaaacttgaatannnngnnnnnnnncagtctcantgcannncgnnnnaacannc

SEQ ID NO: 274 - DNA, 810 bp, Zea mays
ttctcctcgtcctccctaactcttgtttgttagcggctaatttcagagcttttgttggcaactgggggaaccatagtgcgggggttcctcgcccccctctttccatgggagcttagaagctgttggatctctgcaagtgaccatgagccagagtgagtgtttttcttgtgatttctcgtcgtttatttggtgattcttgattgccgcggccaagacatcatctttattgtacttcctgggggtggacctaggtagggcgatgagagcagcggttcttgtttcttggcgggggctcttgattgcttctgatgctgctaagtggatcccactacccgatatagggagaatagagaaaagaaaacatcggattcttttgagcgcttgtgtttcttcagtgattgatggaataggcagggcgtttgttagattctttttgagctcatgctccactctggctcgaattcgtcgttgagcttttggtacagctgtagcggaataacggatgggatgttcgtacaagctcttggaagcataaatatgccctttcctaccgtataaaggtgcaaatcttggcaaggttcatggcttatgttggggtttcgacactgctgagatcagtacattccctagacgagcttgaaaaacatcggaatttttcttttttataactttatacaatatacctttatattgagatgggaatgatttctttaactaatcatattccatgatgaggttcatgttaatgttgaaactttatttggggcccattggggtttaatagaaaattaaataatgcccgcgccctaa

SEQ ID NO: 275 - DNA, 756 bp, Zea mays
  misc_feature (11)..(11): n is a, c, g, or t
  misc_feature (13)..(16): n is a, c, g, or t
  misc_feature (365)..(365): n is a, c, g, or t
  misc_feature (466)..(466): n is a, c, g, or t
  misc_feature (471)..(471): n is a, c, g, or t
  misc_feature (496)..(499): n is a, c, g, or t
  misc_feature (529)..(529): n is a, c, g, or t
  misc_feature (560)..(560): n is a, c, g, or t
  unsure (1)..(756): unsure at all n locations
gctagtatganannnntgtacatcgcaccaaagtgttttacaccaaaaagctcggagacagcagctggcacaatagcccagtgagctccatatccaagtccaaccagcaagctcgcaatgtacatagttccaggccaagccatagcaaagaggaaatgcccagcagccatcacgatctgagcaactgccaatgctatgtgccttgggtatgtacgttccctgattaaaaagaatagccagtcaggatgagaacacatataaaaataagtttcataacttgagtgtgcataggaagtaactacaacttgagtgtgcataggaagtaagtctaggaaaatacataatagatacgctcaaaatataanaagaacatttctaattatctaaaagctctactattctggagcattttagagagcaaactccagaagttaaatacaagtgtatcctagatgagtatctgaanggganttaaaagtgtccacctaaactaagnnnntgaaacgaagagcatttaatttggtatggnaagttctgattgtcaaagcaacaataccaanaccaatcgtttctaccaagaaacaactgtatcagcctttttcctgagactaaaagcgaatggtagattgcttagtgttggtacctgacaatgatctcagagaagtagccacctccaacacgaccaagaaagttccatatgctcaccagtgacacaaagatatgtgcatttttataaccaatagcctggctcatctg

SEQ ID NO: 276 - DNA, 514 bp, Zea mays
  misc_feature (23)..(23): n is a, c, g, or t
  misc_feature (25)..(25): n is a, c, g, or t
  misc_feature (32)..(34): n is a, c, g, or t
  misc_feature (82)..(83): n is a, c, g, or t
  misc_feature (209)..(209): n is a, c, g, or t
  misc_feature (292)..(292): n is a, c, g, or t
  misc_feature (393)..(399): n is a, c, g, or t
  misc_feature (407)..(412): n is a, c, g, or t
  misc_feature (424)..(432): n is a, c, g, or t
  misc_feature (439)..(441): n is a, c, g, or t
  misc_feature (443)..(463): n is a, c, g, or t
  misc_feature (468)..(491): n is a, c, g, or t
  misc_feature (493)..(493): n is a, c, g, or t
  misc_feature (496)..(500): n is a, c, g, or t
  misc_feature (502)..(511): n is a, c, g, or t
  misc_feature (513)..(513): n is a, c, g, or t
  unsure (1)..(514): unsure at all n locations
tagcccagtgagctccatatccnantccaacnnncaagctcgcaatgtacatagttccaggccaagccatagcaaagagganntgcccagcagccatcacgatctgagcaactgccaatgctatgtgccttgggtatgtacgttccctgattaaaaagaatagccagtcaggatgagaacacatataaaaataagtttcataacttgantgtgcataggaagtaactacaacttgagtgtgcataggaagtaagtctaggaaaatacataatagatacgctcaaaatataanaagaacatttctaattatctaaaagctctactattctggagcattttagagagcaaactccagaagttaaatacaagtgtatcctagatgagtatctgaannnnnnntaaaagtnnnnnnctaaactaagannnnnnnnngaagagnnntnnnnnnnnnnnnnnnnnnnnngattnnnnnnnnnnnnnnnnnnnnnnnnancgnnnnnannnnnnnnnnant

SEQ ID NO: 277 - DNA, 751 bp, Zea mays
  misc_feature (124)..(124): n is a, c, g, or t
  misc_feature (129)..(129): n is a, c, g, or t
  misc_feature (135)..(135): n is a, c, g, or t
  misc_feature (217)..(217): n is a, c, g, or t
  misc_feature (390)..(390): n is a, c, g, or t
  misc_feature (420)..(420): n is a, c, g, or t
  misc_feature (601)..(603): n is a, c, g, or t
  misc_feature (605)..(605): n is a, c, g, or t
  misc_feature (630)..(632): n is a, c, g, or t
  misc_feature (638)..(639): n is a, c, g, or t
  misc_feature (661)..(664): n is a, c, g, or t
  misc_feature (670)..(670): n is a, c, g, or t
  misc_feature (672)..(672): n is a, c, g, or t
  misc_feature (675)..(679): n is a, c, g, or t
  misc_feature (681)..(692): n is a, c, g, or t
  misc_feature (696)..(709): n is a, c, g, or t
  misc_feature (711)..(711): n is a, c, g, or t
  misc_feature (715)..(725): n is a, c, g, or t
  misc_feature (727)..(749): n is a, c, g, or t
  unsure (1)..(751): unsure at all n locations
catgcctgcagctcagctagcctcactgtcgccctcgtcagtcttatatattttatgtgctctcttgttcccttgtgtgatgtctcctcttcctctccctatccttgctttctgtgcctctcancaaanggcagngttccttgctatgtcatctagctagatagcacagagcaagctgcctgggcaggcagctagaaaattaacaacaaaaaaaaanggtcaggagcagtgggatttggtagcttgctgttgcttttggcttcgtctccgggcacatctcactgctgaaacctcatggggagggctccgtgctgcgacaagaacaatgtgaagaaagggccatggtctcctgaggaggacgccaagctcaaggagttcatcgagaagcanggcaccggtgggaattggattgctctcccncaaaaagcaggtagtatatatatgtgcatgatttatcaacctacatatacatagagtcatagatgtgatgtggcttttcatcagctggtttggggatttcatgatgttaacagttgagtttgagtccaaacagtctaggttcttggtgctgatgtctttctttttttttctttctaatttnnntncccccttatttatgttttttctgcnnngatctnnttgagatcgatgacctcaaatnnnnattgtncngannnnncnnnnnnnnnnnnaaannnnnnnnnnnnnnanatannnnnnnnnnntnnnnnnnnnnnnnnnnnnnnnnnca

SEQ ID NO: 278 - DNA, 511 bp, Zea mays
  misc_feature (12)..(12): n is a, c, g, or t
  misc_feature (24)..(24): n is a, c, g, or t
  misc_feature (27)..(27): n is a, c, g, or t
  misc_feature (69)..(69): n is a, c, g, or t
  misc_feature (73)..(73): n is a, c, g, or t
  misc_feature (81)..(84): n is a, c, g, or t
  misc_feature (86)..(86): n is a, c, g, or t
  misc_feature (88)..(88): n is a, c, g, or t
  misc_feature (97)..(97): n is a, c, g, or t
  misc_feature (174)..(174): n is a, c, g, or t
  misc_feature (192)..(192): n is a, c, g, or t
  misc_feature (243)..(243): n is a, c, g, or t
  misc_feature (310)..(310): n is a, c, g, or t
  misc_feature (331)..(331): n is a, c, g, or t
  misc_feature (367)..(367): n is a, c, g, or t
  misc_feature (380)..(380): n is a, c, g, or t
  misc_feature (485)..(485): n is a, c, g, or t
  misc_feature (499)..(500): n is a, c, g, or t
  misc_feature (507)..(507): n is a, c, g, or t
  unsure (1)..(511): unsure at all n locations
gtttccttatcngaaaatctccantcntctgccttgctgctcgttcctgcagctcagacgtcgcctccnttcnatcccttnnnncncntctctctcngtctcctcagctcactttgccggcagccaggtttgttagccgagcccctccaattggtgtgctcgacgtttcacacngtttcctagccgtccganacacaggcgtccagctcttcaccattccatcgcttagctcctttcctcttnctcggacattgcattttcctagcccctctgcgccttgggtgtctcggcgctgccatcatcaccctgntctacatcttgttgcccagcnatggcgtctctattttcttagttgttccatgccggngtccgtgcttgcntttgccacagccggcgtcatcaacttcctggtgcccgaccctgctgtccaagctctacagatgtggggagacttgcttggtgcttgcttcccggccaccatgggnatctcgccgtcganntatagcntgca

SEQ ID NO: 279 - DNA, 484 bp, Zea mays
  misc_feature (33)..(33): n is a, c, g, or t
  misc_feature (217)..(217): n is a, c, g, or t
  misc_feature (235)..(235): n is a, c, g, or t
  misc_feature (370)..(370): n is a, c, g, or t
  misc_feature (433)..(433): n is a, c, g, or t
  unsure (1)..(484): unsure at all n locations
ctcctgttgacttgcagcggagagaccaggagncatggtgatccctccaccagcaagggcagctagagtcacccgtttcctcaagccctacctattgaggatgcatttctcaaacaagtatgtatctgctcaggtcgtccacaccccaacagcaactgttgcatgttctgcaagctcgcaggagaagctgttgagaccaaacatggagtcgacccgngacgtcgcagcagctgcnaagattggaaagttgctcggcgagcgcctgctcctcaagggaatacctgcagtgtccatccacatgaagagagaacaaaagtaccatgggaaagtgaaggccgttatagattcagtcagagaagctggagtcaanctgttgtgattgcgatgttgaaaacattggacttagcatttgtgcaatggctgagctgtaatntttaagtgtttatcaatgcaaaatggctggacgttgctgttctgaaattct

SEQ ID NO: 280 - DNA, 635 bp, Zea mays
  misc_feature (4)..(6): n is a, c, g, or t
  misc_feature (8)..(8): n is a, c, g, or t
  misc_feature (42)..(42): n is a, c, g, or t
  misc_feature (47)..(47): n is a, c, g, or t
  misc_feature (51)..(51): n is a, c, g, or t
  misc_feature (108)..(108): n is a, c, g, or t
  misc_feature (122)..(122): n is a, c, g, or t
  misc_feature (129)..(129): n is a, c, g, or t
  misc_feature (138)..(138): n is a, c, g, or t
  misc_feature (177)..(178): n is a, c, g, or t
  misc_feature (182)..(188): n is a, c, g, or t
  misc_feature (236)..(236): n is a, c, g, or t
  misc_feature (310)..(310): n is a, c, g, or t
  misc_feature (354)..(354): n is a, c, g, or t
  misc_feature (383)..(383): n is a, c, g, or t
  misc_feature (387)..(387): n is a, c, g, or t
  misc_feature (417)..(419): n is a, c, g, or t
  misc_feature (545)..(545): n is a, c, g, or t
  misc_feature (567)..(569): n is a, c, g, or t
  misc_feature (602)..(625): n is a, c, g, or t
  misc_feature (628)..(634): n is a, c, g, or t
  unsure (1)..(635): unsure at all n locations
ctcnnncncacacacaacatgacatgacgcacaccttcctcngcgcncgcnccttttcatttttctttctctcttaattaagtagcaattatatcttagttaggggtntgtgtttgtttccnttttagnttatataantcgattatggtagaagaatatgaggataaaatattactnngcannnnnnntgcatgtgtgtagatgtaatcatccgtccgatcgcgaacacgaaagcncgctacggttttcgtcaaccctgcacgcgacggtagctagcagccgtcggatccgagatagaggagcattcaantcattgatgaagcgcatcgcatggagatggaggtttagtttttnaaactttgtgctggtggacgaaaacgaangaangcctacactgatgagctagctagtagtagnnnaacggacggtgcatggaccaacgtgcagtgtggtgctctcacacgtttttatattggattggttgttgggagaggagaggagagatggttggaaggcacgagttgacggcggaggcctctcagacngcgtcatggccaggccacggcnnncggcagcagcagcaagctgtctgtctggcccgnnnnnnnnnnnnnnnnnnnnnnnntcnnnnnnng

SEQ ID NO: 281 - DNA, 745 bp, Zea mays
  misc_feature (31)..(31): n is a, c, g, or t
  misc_feature (70)..(70): n is a, c, g, or t
  misc_feature (526)..(526): n is a, c, g, or t
  misc_feature (528)..(528): n is a, c, g, or t
  misc_feature (530)..(532): n is a, c, g, or t
  misc_feature (534)..(534): n is a, c, g, or t
  misc_feature (595)..(595): n is a, c, g, or t
  misc_feature (597)..(599): n is a, c, g, or t
  misc_feature (607)..(607): n is a, c, g, or t
  misc_feature (620)..(622): n is a, c, g, or t
  misc_feature (632)..(632): n is a, c, g, or t
  misc_feature (634)..(640): n is a, c, g, or t
  misc_feature (645)..(655): n is a, c, g, or t
  misc_feature (659)..(744): n is a, c, g, or t
  unsure (1)..(745): unsure at all n locations
tgcccccccctccttttatagttatacaatntgtacatcatgtctatgaagaacatccctttgaaatccnttgcttacatactaaaacaaagtactgatcaaactagatacacttaaggcaaaataaatcagctgcattactgttgtatcattactatgataacatttgtcagctgagtaaacaaaaggcattgttaaaaaaacatttgcaatcaatgtgtcctagagccagaaattaaagctaaacttcccaacggagctcacttaggagggctcaattgatatattatgcaaataaaaaaaactcagccagggaaggaatgaccgccatcccggtattatatcaagatacactaaaacaatggtctcggccgagaaaatccccaaactctgccccccccctccccatcactaacgagccgacgtcaaccgtcccctctacagcggtccaaccggagggtggcgcacaggaagccggaaaattcgcccctgaggggaatcgaacccgagacttggaggtgctatncngnnntncggaagcctttaaccactaggctagaggccatttcgcatatattatgcaaataacaaatangnnngaatgcangagtatctaaccnnngaagtgatgngnnnnnnngatgnnnnnnnnnnnacannnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 282 - DNA, 1398 bp, Zea mays
  misc_feature (65)..(65): n is a, c, g, or t
  misc_feature (405)..(405): n is a, c, g, or t
  misc_feature (418)..(419): n is a, c, g, or t
  misc_feature (422)..(422): n is a, c, g, or t
  misc_feature (427)..(427): n is a, c, g, or t
  misc_feature (441)..(441): n is a, c, g, or t
  misc_feature (449)..(449): n is a, c, g, or t
  misc_feature (452)..(452): n is a, c, g, or t
  misc_feature (471)..(471): n is a, c, g, or t
  misc_feature (477)..(477): n is a, c, g, or t
  misc_feature (493)..(493): n is a, c, g, or t
  misc_feature (496)..(496): n is a, c, g, or t
  misc_feature (501)..(501): n is a, c, g, or t
  misc_feature (504)..(504): n is a, c, g, or t
  misc_feature (507)..(507): n is a, c, g, or t
  misc_feature (517)..(517): n is a, c, g, or t
  misc_feature (532)..(533): n is a, c, g, or t
  misc_feature (539)..(540): n is a, c, g, or t
  misc_feature (542)..(542): n is a, c, g, or t
  misc_feature (547)..(547): n is a, c, g, or t
  misc_feature (552)..(552): n is a, c, g, or t
  misc_feature (562)..(563): n is a, c, g, or t
  misc_feature (565)..(565): n is a, c, g, or t
  misc_feature (578)..(579): n is a, c, g, or t
  misc_feature (582)..(582): n is a, c, g, or t
  misc_feature (584)..(585): n is a, c, g, or t
  misc_feature (597)..(598): n is a, c, g, or t
  misc_feature (649)..(650): n is a, c, g, or t
  misc_feature (685)..(685): n is a, c, g, or t
  misc_feature (732)..(732): n is a, c, g, or t
  misc_feature (777)..(777): n is a, c, g, or t
  misc_feature (838)..(838): n is a, c, g, or t
  misc_feature (905)..(906): n is a, c, g, or t
  misc_feature (1344)..(1354): n is a, c, g, or t
  unsure (1)..(1398): unsure at all n locations
tgagcatatcctacggctcatgctaacaaaaacaaaatccactaagaataagcaacataattgantacagcacacaaagttaccaaaattgtgtatgcaacacgcacaagcgagtatcagagttcagaaacatccattatacgattgcaaaagaatttgcaatgaggtgaaacatgaagcaattaatcaagcaaataagtgtcccactatagaatgcttctatattttcatgtatctataaatgagaaagatatttttttgaaggccaatacatgcatatggacgtgtagcctctacatccagggagaataacatcacacttagtaatgaaggcaagagtgtggtaaaggaaaaattgaaatcacaagcaatatagaggtaccatttgagtaagtgaacataggntcctgaaatagcnntanttagnccataaagaatatntgtatctntgntcagtcaaccaaaactttntttttnggtggagaaccaaagnaanatganacntantaatgaaggnaagagtgtgctaaannaaaaanntnaaaanacaancagtataganntntcacctgagtaanngancnnaggatcctgaannagcgctagttagtccatcaagaatatttgtatctgtaatcagcaaccaaannttttatttttggtggagaaccaaagcaactattcncattatgtatggagtagaaaccagaacttaagttcaaatacataganagtggatcatgatcaacatatttaatcccttctttgaatcttgtntatccttttctagaactgatatctttagctccccttaaaaatggactgtcaacattctggntttagggagaataacatcacacttagtaatgaaggcaagagtgtgctaaaggaaaaaattgaaaacnnaagcagtgtagaggtactatttgagtaagtgaacatagggtcctgaaatagcactaattagcccataaagaatatctgtatctatggtcagtcaaccaaaactttattttttggtggagaaccaaagtaaatgatacctactaatgaaggcaagagtgtgctaaaggaaaaaaatgaaaacacaatcagtatagaggtgtcacctgagtaattgaacataggatcctgaaatagcgctagttagtccatcaagaatatttgtatctgtaatcagcaaccaaaacttttatttttggtggagaaccaaagcaactattcccattatgtatggagtagaaaccagaacttaagttcaaatacatagacagtggatcatgatcaacatatttaatcccttctttgaatcttgtttatccttttctagaactgatatctttnnnnnnnnnnnaaaatggactgtcaacattctggcccactatggggaacttaccc

SEQ ID NO: 283 - DNA, 1423 bp, Zea mays
  misc_feature (1385)..(1408): n is a, c, g, or t
  unsure (1)..(1423): unsure at all n locations
ggacggcactgaaccttcctggaatccccattgccatcgggttgtatgggtattgctactcaggccatggagtgttcccaaacatctactcttctctgaagaaaagcaaccagttccctgctgttcttttcacctgtatcgctctgtctactgttctgttcgctgctgctgcaatcatgggatacattatgttcggtgaatctacagagtcccaattcacactgaacttacccccaaatcttgtggcttccaagattgcggtctggactacggtgacgaatccaataaccaaatatccttggacttctacttcagctttctgtgtgcatttgttcccatacttaacaagtaacattacatgatatcttactttctctaatcacatgtaactccatgtagccatctaggtttgtgctaatcaaacatattttaaattttgactagaaatatctataaaaagtattatcttaaataagcagagttatttggttttaataaagaatttagcaatgtcaatgttatttttctcgttctatataaattttggatattcatggtcaaagttaaaaaatatttgacttaggacaaatatagatatacctgcattgttattttagtgagtcctatagttctcctccccaaactttgctatcaacatctaacagttaatccagttttcatgaataaatgtagtttcaatcgttctgtgttgtttaataatgttttatggatcgcatgctatgtccttaactaatacctacatatgcgctgaccatgactcctctagccctgagtttggaggaactgctacctccaaataagcagacatacccgaacataatgatgcttagatccgctctggtggtatcttcccttattattgctctgtccgttccattttttggacttgtcatgtcactggtcgggtcttttctcaccatgtttgtggcctatattctaccatgtgcctgctttttgtctatcctcaggagtaaagtcacctggtatcaggtagtactgtgtgtgttcatcattgtcgttggactttgctgtgttggtgttggcacgtactcttctctttctaagataatacaaaagtaccaatgaattgtgccctagaattatgtatgatgtgtccatgtgttttcgaatagccagttttcttttctgggatggtggcgctggtctggaagggggagggggatgtcattctttgtaaattttttgttggcatgagaggaagtggaggaatttgataaaatagggcaggttgtgttatcgaaggagtattttgtctgaaattgttctcgtgacggtaggtgctgctgggaacgaccttctgttgacgctgccattttcgtttgacccatattgtttcttgtctnnnnnnnnnnnnnnnnnnnnnnnnagggggcgtgtaccc

SEQ ID NO: 284 - DNA, 684 bp, Zea mays
  misc_feature (640)..(642): n is a, c, g, or t
  misc_feature (650)..(653): n is a, c, g, or t
  misc_feature (661)..(661): n is a, c, g, or t
  misc_feature (665)..(669): n is a, c, g, or t
  misc_feature (671)..(671): n is a, c, g, or t
  misc_feature (674)..(680): n is a, c, g, or t
  unsure (1)..(684): unsure at all n locations
tcattttgagacctaaccacttcgtgtgtgcgtgcctgcattcctgcgtgggacgaacaacatttaatagcaaatactttccctcttgattatttctctctttgacatagataattccatatgcttatttgacccttctttatccttggcagccccttcatacaaggactaacatgtttataaaggtattagctgggcattctactttttgttcatgagctcaagcatgtgtttagtaaattatcttatgctaatatagcaaaccatggaaactaaaagatttacctcttttatctgctctgtgtttccttcagtttataaggacattatactatcaactcaagcatggttttcaacatacccaagattccaaaagtggggatatgggcaattctctgtgtttggatgaaacatggttttcaagagacatattcctgtaccgtctttcaaaggtaattctgctgatacagtattgatacacacaaggattaagatcatgtttttgttatttcctaaatttaactatgttacttacacaaatattatgttacaaacgcgaatgtggtgaaatataagtatagttaaccatattttggtatgccaagttagtccccaacaagctaccaaatacaagagctannntcataacnnnntattttangatnnnnncnaannnnnnnccat

SEQ ID NO: 285 - DNA, 1034 bp, Zea mays
  misc_feature (6)..(6): n is a, c, g, or t
  misc_feature (69)..(98): n is a, c, g, or t
  misc_feature (117)..(117): n is a, c, g, or t
  misc_feature (149)..(149): n is a, c, g, or t
  misc_feature (257)..(265): n is a, c, g, or t
  misc_feature (270)..(270): n is a, c, g, or t
  misc_feature (474)..(474): n is a, c, g, or t
  misc_feature (476)..(480): n is a, c, g, or t
  misc_feature (484)..(484): n is a, c, g, or t
  misc_feature (507)..(507): n is a, c, g, or t
  misc_feature (1015)..(1021): n is a, c, g, or t
  misc_feature (1026)..(1028): n is a, c, g, or t
  unsure (1)..(1034): unsure at all n locations
ccggcnacgagcaccgagttgttgacggcctggtagttgctgttggcgtaggcggtgatgaccacgttnnnnnnnnnnnnnnnnnnnnnnnnnnnnnngttgtcctggtggccatgnccttcgtcgtgctcctccgcgtccacgctgcngacgacgacgaggtcctccacgtcgcccgcggccgccgcctccatggtggcgccgctgttcttcccggccagcgtgatgacggtgccggcgttctcactgccgctgcnnnnnnnnntgagngcggtggcgaggtggtcgttgagcttggccacggcgctgctcacctcgctggccacggcgacgttgtcgttggacgccattgattggtagcgagctagctgtttcttcttcttgcgatcgagtttggtagaatgtgtatcgcaaaatgatgatcgggatgtgcagtggtgctcgatgaactgaaaggctagctagccttgaccngnnnnntgcncatatatatatgtggatggtgcntggtgagttcagtcacacttataatgtttgcttggcaattccattcattattcttgtgttagacgtgttttactcattcatcccaagtttagcataaaatgttctgcctcaattcctttagctactaaaagttctcactacatgtagggagacagtagagaactacttggtgattggttattctttttggtcatattgtatttctgtgaagaatagctcacaattgattgtcttcctaccaaaatgcaagcctactaaccggttctgcatttcttgcacttccaggtactgaagcaccaaaaggttattgaggaactgcaggaggaaaacgaaaatctgcgtcagattctgatagaggaacttaagatttcaccaaccaaattacaaataggtcataaaaatggagtgaaggcctactatccatgctcggactgctttgaatgtcgccgcagaagtcggagaacaaccagatagcagtgggcattgccgttctttggttgagcaaaannnnnnncgttnnntcagta

SEQ ID NO: 286 - DNA, 740 bp, Zea mays
  misc_feature (10)..(10): n is a, c, g, or t
  misc_feature (95)..(97): n is a, c, g, or t
  misc_feature (527)..(527): n is a, c, g, or t
  misc_feature (543)..(543): n is a, c, g, or t
  misc_feature (569)..(569): n is a, c, g, or t
  misc_feature (599)..(600): n is a, c, g, or t
  misc_feature (658)..(658): n is a, c, g, or t
  misc_feature (660)..(660): n is a, c, g, or t
  misc_feature (670)..(670): n is a, c, g, or t
  misc_feature (673)..(675): n is a, c, g, or t
  misc_feature (677)..(677): n is a, c, g, or t
  misc_feature (681)..(682): n is a, c, g, or t
  misc_feature (684)..(685): n is a, c, g, or t
  misc_feature (687)..(687): n is a, c, g, or t
  misc_feature (696)..(702): n is a, c, g, or t
  misc_feature (704)..(705): n is a, c, g, or t
  misc_feature (707)..(708): n is a, c, g, or t
  misc_feature (712)..(713): n is a, c, g, or t
  misc_feature (717)..(717): n is a, c, g, or t
  misc_feature (719)..(721): n is a, c, g, or t
  misc_feature (727)..(727): n is a, c, g, or t
  misc_feature (730)..(731): n is a, c, g, or t
  unsure (1)..(740): unsure at all n locations
accacaatgntagggcatcatggcaccgacaggaattggaacaggtacaaacccatatgagggatggctcatactgtcctttctatgggaagaannnctacttgcaccagcatcttccctagcactactggagcaaatgatgtcagcaccctccatgctactgtccagagtaattcgagcttgccttgtactctcacctgtattatggtcattgggaggcagcaagaccccattgggttggaaaactgggtccttgccatgaacatgctgctcttgcccaacaatgcaacgagaaggaagaaactgtatctcacctgatgattctatccttctattgccatatctgtgtcatgttgaagccatggacaagttaaataaagctagtcagagttatgcaatacatttgagcagttactaacatcgacttatcgccttatcggtctatagaagtactaaacatgtaacctcataaagaaacaaatgggcatggacagaaagccatgcatttcagataatttccagccacnttcaagaactagatanccaatcaaaattttagactaaagttnaaaaaatccatcagcacaaagtacctcgannaggcagaagaattcgagtgattaaagatatctttttccctgaattcttgattcttgtnancattacgatnctnnngntttnncnngntggtctcgnnnnnnngnnannggtnngaancnnnatgacntannacagcactc

SEQ ID NO: 287 - DNA, 626 bp, Zea mays
  misc_feature (365)..(365): n is a, c, g, or t
  unsure (1)..(626): unsure at all n locations
ctcggtacccctggcctcctgcttttgcttatcgaaacctcgctcctaaatatcccatcgtcgtcgtttgccatccgccgccggcccgccgccaccactgcaccgcccactagctagtagctagacgaccggccggagatggatccagttccggtgtggttagagtggttccacagggacggggcggagctcgccaaccgcggccgtcggccggatcatcttgatgatgaggacgatctctacgtagccttggccttggctccctacgttgatcgccaccggcctcgaacccgtccccgatccccatccccatccccgccctcacacgaggacgccggggacgacactgctgctcgcaacaacangcgtccttgcatccccgcgtacagcgaagccatcctggggctcaaggaggtggtgccaaccgctaagcacgacgacgactgtgccatctgcctcaacccattggccgatatcgctggtcctgatcacaagaaggacgacgcggcagctacgtcgatgcttcgggccatgccctgctcccatatcttccaccagcactgcatcttccagtggctccatcgcaacgccgtctgtcctctctgtcgctaccaggggtaccgagc

SEQ ID NO: 288 - DNA, 273 bp, Zea mays
aaaaggaaccattgcatgcaggagaaaagaaatgatgagataaagggaaaaaaaaggagggagagagagagaggaaccaatgcaagaaggtgatccgatcaacaggcagagacatggccattggtcgatctagccacggtctctactcgctgccggggggcttgtaggcgatgaagctgacgcactgcgtctgcctgacgttgtcgaagccgatgacgcggtggaaggcgtccgggtacgcggcgatggcctcctgcagctccttgtaccacc

SEQ ID NO: 289 - DNA, 506 bp, Zea mays
  misc_feature (65)..(65): n is a, c, g, or t
  misc_feature (90)..(90): n is a, c, g, or t
  misc_feature (149)..(149): n is a, c, g, or t
  misc_feature (317)..(317): n is a, c, g, or t
  misc_feature (440)..(440): n is a, c, g, or t
  misc_feature (471)..(471): n is a, c, g, or t
  misc_feature (497)..(497): n is a, c, g, or t
  unsure (1)..(506): unsure at all n locations
gacacaattcacaacatgtaaattgcaataagtctgacaaaaggagaacatacaatgctgtgatnctgtaatttgatgtcgaaggaatgngggatgttggccctggcaagtttcttatcacgatatcaggatctcttaaaggagatacncttttgtatgatgaagttgcaatcttcatgtcgagaaaaatttaccgttaagaaatcatgaaggataccttgaaatatgatcacatgtcatattataataaactgtgctcatgttcgtagcttacatatacttaaatatatacatgcatatcttacatcattgtctantacagaacacatgcagatttcataatggagcaactatttgacagtgttagtgccaaaaatcataggcaggatgtggaagtcgtaccatgctatttttcccaccagttgaagtaggaaacatancccttgtgatgccagacctagaactcctgantgtagcatggtcttttacaaaagggngatccatca

SEQ ID NO: 290 - DNA, 546 bp, Zea mays
  misc_feature (545)..(545): n is a, c, g, or t
  unsure (1)..(546): unsure at all n locations
cgtcgccaggcgagcgcagttcaggctcggccgccgccctgcccgctttgatgttttcagccaatgccgcgccgtcgacgcctccatggcctgcagccgatgacaacgccaagtcagacaagatatatagtagtagactagtagtaatagaacgcgctttgtatattttatatacgcagaccctgaccatgacgtcgatgccagaggcctccaacgcgagggagacgccgtcgtcgtagttgggcgtcgccggcatgtcgtcgtccacacgcagccatctcttgagaagcaagtggtgcggcattttcagcacgagctcgccgtagcaggagtgcgcggcctccggggactctgcaccggctgagctctgagaggcgaaggtggcgtacagcatctgtaccgcggcggtcgggttgtccacgcacgccgcgccttctggggagcacagcacgtacgtcccaaacggccggtacgggctcccacctgtcgtctcagaagcggcaagcttctgttccacggccacagcgccaacgtgcgtctgtatna

SEQ ID NO: 291 - DNA, 703 bp, Zea mays
catggttgctcatctttgtttgtcgaacctctgaaatggatgactccaggtaggcttgatgttattaccttcctcttggagtatgaatctgtatggctgatgaaatttttatttgtgttgtgcaaagaaaaaaaaagccatataagtcctgcgcatatggttggttcctattgaacccatatacagagtatgatgcttaggtcaccttattactgaaacctgaataagtgaatatacttgatgtttgagcaattgcacaccctgtttggtcttagtagcacggttttattgccccatccttcgttaactaaaacttacatggtttcacctgcgcctttgttcacctagcagtagaagacggcgctttggagggaaagctatcatgcatccactgtggagctcggttgggatacttcaactggtcaggaatacagtgcaactgtggtagctgggttactcctgccttccaaattgttaagagcaaagttgatatcagcaccatctagacctgtgagcaaacgactggcaagtttgagggacgaggagcgcgacagcagtgacgcctgacggtttaatgttttgtgtaccatatgaacgctacgtatacaggtgaagcaatagcgtattttatgtttttccattgccgatcagaagctgtgtgtgacaaataccgtataaaatttcgcatttgctgatgtaacaa

SEQ ID NO: 292 - DNA, 484 bp, Zea mays
  misc_feature (140)..(140): n is a, c, g, or t
  misc_feature (144)..(144): n is a, c, g, or t
  misc_feature (158)..(158): n is a, c, g, or t
  misc_feature (280)..(280): n is a, c, g, or t
  misc_feature (285)..(285): n is a, c, g, or t
  unsure (1)..(484): unsure at all n locations
ttgcctcttgtacaaatcttgtgactcgtcctgcatcgaaggacaacacaatttgagatctggactcaaggtgtgcctggaaacgctttacagaaacattgagtgaaatgcatgcatacaaggcctgagaactgactgcnaagnggggaaaaacactntacagaaacattgagtgaaaacaatattaatcgctctcttagccacaacaggctaaagctaagctaagctaagccaatggcactcagagattcggtacggcattttcttctctggctttttnaaaanggactacttgcaagtaaatgacaatgtgtataccttctctatagaaccaaataatgctcccacaagtcacggacaaagaggtgatataatcgagcatgacaatgtatcttaaccattcggtatcatagtactatagcatccttcgagacaaatttacccatgaaccttggtatgcccaatttacatgcacaaagagaca

SEQ ID NO: 293 - DNA, 555 bp, Zea mays
  misc_feature (130)..(130): n is a, c, g, or t
  misc_feature (137)..(137): n is a, c, g, or t
  misc_feature (144)..(144): n is a, c, g, or t
  misc_feature (154)..(154): n is a, c, g, or t
  misc_feature (185)..(185): n is a, c, g, or t
  misc_feature (214)..(214): n is a, c, g, or t
  misc_feature (300)..(300): n is a, c, g, or t
  misc_feature (493)..(493): n is a, c, g, or t
  misc_feature (513)..(515): n is a, c, g, or t
  misc_feature (517)..(520): n is a, c, g, or t
  misc_feature (533)..(546): n is a, c, g, or t
  misc_feature (549)..(551): n is a, c, g, or t
  misc_feature (554)..(554): n is a, c, g, or t
  unsure (1)..(555): unsure at all n locations
cctggcgcctgatgttgatcatggggtggctactctccaactctttgtacaatgcaatgcaatccttgtgcctcctattggcttcatatgccattgcaagccaaatttggatctagaagaagatacacgntatatancacaaanatgtctacangattttagccatagactacatcacaaagatncctacagaattcaactcactcaaaagacnttatttggcatgaaaactacagaaatctcaactgcagagatactacctcgccaccgagtagagaggagggacgtatgatagtgagngcagcctccaagaattcaattgatcgtccatacattcctttcccgtacgccttttgacccaactcaaacatttgcttcgccgtctccctcctctccgcttgctccttcgctacctgcaaagctcgcgcaacaaaatgattttgtctcactctaccctcaccctcctgcaaacagcgctaaaactagaaccagntgcatgtgcgtcacaaatgnnngnnnncatgtggaacttnnnnnnnnnnnnnngtnnngtnt

SEQ ID NO: 294 - DNA, 631 bp, Zea mays
  misc_feature (101)..(101): n is a, c, g, or t
  misc_feature (221)..(221): n is a, c, g, or t
  misc_feature (427)..(427): n is a, c, g, or t
  misc_feature (491)..(491): n is a, c, g, or t
  misc_feature (503)..(503): n is a, c, g, or t
  unsure (1)..(631): unsure at all n locations
gttggtgatgcaatcatacaatagatggatcttgtgaaaacttgatttcataggagtgattctagggtgagtctattgaatgggagtagggagttattagncagacatatgtaattatgaatttgagaggttaacagaaaccaaatacaagtggaggagggagcaccaatacaatctgctgaaatttgtggatcgtcttttttctactttgaaccaatgcncacgtccccaaccatttcataggaattaggatcttatgttatttagagaatccaaaaactcctgggacttgtcaaaaacaaattaccgaaactgaataccactgcataaccaagggattcaggctttcaggtccatgtggtaaacattgcaaaatatgtgctatcttcacttttctgatgtttattatgaatgcatcttttttttngaaagtcattatgaatgcatcttctgaaaattgagttcactctgcaggtttcttttgtatttgnataacctataanggtctcagcacccagtatgatttggttggcaaaggatgttttctccagaataatgaaagtttagcttctggttcattttattgtctggtcgatcttttttatactgtgataaaatggggaagcactca

SEQ ID NO: 295 - DNA, 1402 bp, Zea mays
tgctttctgaaggtgcagttatagaggactctttgctaatgggtgcagactattacgaggtagattcaaacagaactctaatatcgtgcaatggaaatatcatgagaacttatcattctttctgttttgttcagactgagaatgataagaatgccctttctgagactggtggcattcccattggtattgggaaaaattcacatatcagaaaagcaataattgacaaaaatgctcgcattggagaaaatgtgaaggtatttcaaatacactgaatttgccttaacctgataatgttttgtatctattggctatcctttaactatagggattaatcaaatatcttatttatgtaaaaaggtttctatgcatctttttttaccgttttccaaaagatagtgactgccgttatctagtttttttcttgttagattctaaattacctgatcatgcatttattttatatatttctatgagagtattaccatgaattgtagatcttctgtaccaaaacaaaattaaaatacaaaataattctagtttattgtttgtacaagttgtttttgactgctcttagagttgataatggacaaaaaatatgcactgatgtttttgttatgtattcattggttcatccttcctaaatagttcattgttttacagataatcaattttgataatgtccaagaagcagtaagggagacagaaggatattttatcaaaagtggaattgtcacggtgattaaagatgctttaattcctagtggaacaatcatataaagtcagccaacgccatgtatataaggtcatatctctagcagaaaccagtgtttttatggttgtcgtactcgtacatagggttactagcttttgctcttcatattgcaactggattaagcttactgcttagttccagcatgtactggagtacttggtaatcatttgaatctagttgcagtatataaattgacacccattttatatctgatatattttacaatagttaatattttgcattatgattattgacattgtctgagcacataatagtttccatttaacaagtacataaaagttccatgttcatccatcctagcacgttaggggctatatgcctatatatatctgctaggcatggaacatagattctgctcctaatatttttttacccaaatcttcttgtgttgacctgcaggttgggttgcatcatatggtgatcgccaatgcgcatcaagttctctcatcccttgcgagaccatgcttatttccattgcaaaatcatcaagctctgcatcaacttgttgtggataataatgaaataataaatggtgccattccatggcaacatttttctgtcactagtatgaggcactgttctaaatgtactgttgagtggaattgaata

SEQ ID NO: 296 - DNA, 537 bp, Zea mays
  misc_feature (465)..(465): n is a, c, g, or t
  misc_feature (513)..(514): n is a, c, g, or t
  unsure (1)..(537): unsure at all n locations
acaggacaacggaggtcggaggccccttccaagcaagcaatgccaagaaccaacaagaacacggcaagaactagcatcactacagttgcaacaaatactaaatcgccatcgatctcgacggcaaattatccgctaatcatcttccacctccagctaagttctctgagaaccatcattgcaaaatgtgctgccacaagcatgcaaacattactcccgccataagcatgcaaacaaggacatcttttcttatctctcttgccccccatctgtcacggcaatgggcaaaatagttcgttctcctgctcaccgacgcgagccaatgatgctccttgatctccattctccaccgccaccgaacggcggtctcgccataggcaccgtttccggcacggtgcgtcacgcggcgcaggtggacggccaggcgtcgcggctctcctcgtcggggggtagctgatgcgggacctngaccggtggcgcgaccccggctgacgccgacgccgacgccgacgccgnngctgcgcgcttgggggcccgacc

SEQ ID NO: 297 - DNA, 328 bp, Zea mays
  misc_feature (83)..(83): n is a, c, g, or t
  misc_feature (106)..(106): n is a, c, g, or t
  misc_feature (117)..(123): n is a, c, g, or t
  misc_feature (156)..(156): n is a, c, g, or t
  misc_feature (222)..(222): n is a, c, g, or t
  misc_feature (237)..(237): n is a, c, g, or t
  unsure (1)..(328): unsure at all n locations
cttcctcaaatgtcataaatcgatcaccggaatgacacgcggaacgaattatagaatcttgctatgttatgcttgcacaacanatcaataaaactcaaacgatggngcgcaccagannnnnnngcagcgctacagtagccgcagcacaaacagcantagaaattgctacagtgcttattagataacattacttgcagcagctctgatgttccaccaaaaaanaagttgaggatatanagaactaaacaggctcaccgatctgaaattaccactctaaagcgcacgggatccatccaagagtataattgcctcgtcagaaggttcccaa

SEQ ID NO: 298 - DNA, 684 bp, Zea mays
  misc_feature (2)..(2): n is a, c, g, or t
  misc_feature (29)..(29): n is a, c, g, or t
  misc_feature (59)..(59): n is a, c, g, or t
  misc_feature (92)..(92): n is a, c, g, or t
  misc_feature (98)..(98): n is a, c, g, or t
  misc_feature (123)..(123): n is a, c, g, or t
  misc_feature (207)..(207): n is a, c, g, or t
  misc_feature (213)..(213): n is a, c, g, or t
  misc_feature (310)..(310): n is a, c, g, or t
  misc_feature (418)..(418): n is a, c, g, or t
  misc_feature (558)..(558): n is a, c, g, or t
  misc_feature (560)..(562): n is a, c, g, or t
  misc_feature (598)..(602): n is a, c, g, or t
  misc_feature (608)..(608): n is a, c, g, or t
  misc_feature (625)..(629): n is a, c, g, or t
  misc_feature (632)..(642): n is a, c, g, or t
  misc_feature (644)..(646): n is a, c, g, or t
  misc_feature (668)..(683): n is a, c, g, or t
  unsure (1)..(684): unsure at all n locations
tntttgtagctttgttattacttgctacnttgctagatgtcccacaactatatgagttngagagaatctagaattcgaactcaactgtttantcaatnctgaatttgcagactagataatacntcaccgatatggaatcttttgtatggtgtatttgttgcttcatttcatcttaatgtttttcatcatggttgttgcatgtatatncatagnaaaaaatggtgtagataattttgcattgcattttaaggtcatatctttatcttctaagtcatctgcaatgtagtatttggtaacaaaaactttgctntttctttccatacagtattaccactatgcggttctaaaatgttctgtaaatttcttgtgcagaatggatgaagctcggcagccattgtccagaaaagttccaatatcntcaagccgaataaatccctacaggatgattatcgttatccggttggtggtgttgggtttcttcttccattaccgagtgatgcatccagcgaaagatgcatttgcgttatggctcatatctgtaatctgtgaaatttggtntnnnatgtcctggattcttgatcagttcccaaagtggctnnnnnttgagngagagacttacctggannnnntgnnnnnnnnnnnannngcatgttgaatggaataaactnnnnnnnnnnnnnnnna

SEQ ID NO: 299 - DNA, 726 bp, Zea mays
  misc_feature (501)..(502): n is a, c, g, or t
  misc_feature (575)..(575): n is a, c, g, or t
  misc_feature (610)..(614): n is a, c, g, or t
  misc_feature (617)..(619): n is a, c, g, or t
  misc_feature (621)..(624): n is a, c, g, or t
  misc_feature (631)..(632): n is a, c, g, or t
  misc_feature (634)..(638): n is a, c, g, or t
  misc_feature (640)..(640): n is a, c, g, or t
  misc_feature (647)..(647): n is a, c, g, or t
  misc_feature (668)..(668): n is a, c, g, or t
  misc_feature (675)..(675): n is a, c, g, or t
  misc_feature (682)..(685): n is a, c, g, or t
  misc_feature (700)..(704): n is a, c, g, or t
  misc_feature (707)..(711): n is a, c, g, or t
  unsure (1)..(726): unsure at all n locations
aagagccggattgccaggtgcttgtttcgtttcgggctgtgtaggtgctcggatgctgatttttttcttctttcttttgtgatgaattgtactgggccgatgaaaccgtatcggattgggttctctgacgaggaaatacataactaataaatacacatacactgagctgaggttgaccttgcacattcctgttgatagagtttatattgctgtcagcaggttcagattagtttgtgttgtgctagtaactaatgcagagcacagcgagtagcaattaaaactgtgagttgcagaggagagtgggtgtattggttgctcaatcaatctatgttggagccagtaaacattcttctctccctcctgcactggctctagatttgttccttccatctctttcttaactcttgcctgacatgattttacttcattcacgagttgaaactttaatcagtataaggcagaagccaaaatgatcatgctagctaaggaacaactgctctnnatgaaattactgtttacatggcattagcatcagtatgttcaatccaatatgattgttgctttctggaaattcngctatgatatacatcactccgattgtctttatagnnnnnttnnncnnnntctgttnnannnnntngaagcanttagttattttggaagtctanttgatgnatggatnnnnatctttgacatattnnnnntcnnnnnataattttgagtctc

SEQ ID NO: 300 - DNA, 708 bp, Zea mays
  misc_feature (594)..(595): n is a, c, g, or t
  misc_feature (618)..(622): n is a, c, g, or t
  misc_feature (672)..(672): n is a, c, g, or t
  misc_feature (674)..(676): n is a, c, g, or t
  misc_feature (683)..(698): n is a, c, g, or t
  misc_feature (700)..(705): n is a, c, g, or t
  unsure (1)..(708): unsure at all n locations
tcaaaatctcggaattaccatccttgctggaactatcacatctactgatcaggcaggcctcgagccctcgatttcatcttgaaataaagcttgtccttttaagttcattatcaatgagagttttgttagagatttatgacattaattagtataccacataagattttttatgacataccgatatatttattatgaaatatgtaaaaataaattcatcaccataaaactatgtcaaacactgctaaggtattgaaaagcgcgtgaaatcattattgataacaatttatttcatatctatctatttctatttgttatttaggtgcaacatttaagtcaagtgttaccctattaaattatgttataaaactcttggttaaaagaacatattttattctttattttatcttacttttattgacatgacaatgttgaaaatggtgtgacgaagctagcacgcgaaatatcctaaccccagttggaagcgagctggtcgttgtcgacactcgacagtaacccaaggcttattattgtatttgcatttttggttttggatgctggtatggcaggcatcttcaggaggatgctacgaatatnngccctcagtcacccgtgtaccannnnntattttcaagctatcacatcatgtcagtttgaatttgacagtcattgcancnnntctctcnnnnnnnnnnnnnnnntnnnnnnatt

SEQ ID NO: 301 - DNA, 648 bp, Zea mays
  misc_feature (203)..(203): n is a, c, g, or t
  unsure (1)..(648): unsure at all n locations
gatgggcatttaccgagtggaacataacccattgtgacataaaaaaagaaaaggttagactctttgctcccagtaagaaaacatcagtagctccaattacaacacttttagcagggtatgttacgcagtgagggattgggaggattctaatgtcaactagtgtggaacagtagcgcatatgaactttccaactgaatcctttnaaatcctagttgctataacacatttagcaaacttatgtgaatcctatgagaccctcacatcctgtattattctttctgcattagcctctccacatacccactagctatcactacttcctgaacacagaactatctggctccactactattggacatacatcagttactacctagaatagctagctacactactatattttcaacaagagtcttatattcatcctagtatctatctctctaattactcaccccatcactgttacatttaatcacaatcttatccttcccacctcatatcaatatgctttttcacatacttacctatttctattacatatcaatcgtactattcttacttcagtctatcacacctctttaccaatcatgtataacttaatatacctatctactacttatttactatatctatttcttcatacttatt

SEQ ID NO: 302 - DNA, 667 bp, Zea mays
cacaggccacaccaatgcactccaaacctggtccggacaaccgtacgcgcgtcatggaaagaaaaaaaaacacacaatgcacatctgtagatcatgtcccattggtgatgttctgactgtcgtaagggtagcagtagcggtaaatgcagaaattatagtggcttaagcatatacgaaaatacactgatcctagcaagaagcactcaacaaaccgacggaaatagaagccatgaaagtaaacttccatttagagtaatgcgtaggcgaatacaaagacagcatcgctttttttttacaggagcaaagaatagggcatgaacaaaacagaaaatgggaaatgctgtaggaatatggatgaattgatcattgtcatatacggagtacatactagtattccaaagagagtcaaagctgccacagcaactgagattacagggggtggtggtactacatataacattaccagccgttcattaagcttacaacatcatgaacataaaaaagcatccacaatcctggcaatgccagcgagaaatcgaatggacataaccttaataaaacagaggttcatgacttagagcaaggatcacgatatagttaccatgatataggaggaacagaatagaacagccgacgaacaacccagacaattgaagcatgaactctt

SEQ ID NO: 303 - DNA, 1236 bp, Zea mays
  misc_feature (21)..(21): n is a, c, g, or t
  misc_feature (45)..(45): n is a, c, g, or t
  misc_feature (48)..(48): n is a, c, g, or t
  misc_feature (58)..(58): n is a, c, g, or t
  misc_feature (120)..(120): n is a, c, g, or t
  misc_feature (136)..(139): n is a, c, g, or t
  misc_feature (177)..(178): n is a, c, g, or t
  misc_feature (180)..(180): n is a, c, g, or t
  misc_feature (198)..(205): n is a, c, g, or t
  misc_feature (207)..(210): n is a, c, g, or t
  misc_feature (212)..(226): n is a, c, g, or t
  misc_feature (228)..(263): n is a, c, g, or t
  misc_feature (265)..(272): n is a, c, g, or t
  misc_feature (274)..(449): n is a, c, g, or t
  misc_feature (454)..(458): n is a, c, g, or t
  misc_feature (463)..(464): n is a, c, g, or t
  misc_feature (466)..(466): n is a, c, g, or t
  misc_feature (476)..(490): n is a, c, g, or t
  misc_feature (493)..(501): n is a, c, g, or t
  misc_feature (504)..(523): n is a, c, g, or t
  misc_feature (528)..(532): n is a, c, g, or t
  misc_feature (542)..(551): n is a, c, g, or t
  misc_feature (553)..(556): n is a, c, g, or t
  misc_feature (561)..(568): n is a, c, g, or t
  misc_feature (575)..(576): n is a, c, g, or t
  misc_feature (583)..(583): n is a, c, g, or t
  misc_feature (659)..(659): n is a, c, g, or t
  misc_feature (722)..(724): n is a, c, g, or t
  misc_feature (735)..(735): n is a, c, g, or t
  misc_feature (747)..(747): n is a, c, g, or t
  misc_feature (760)..(760): n is a, c, g, or t
  misc_feature (860)..(860): n is a, c, g, or t
  misc_feature (881)..(881): n is a, c, g, or t
  misc_feature (903)..(903): n is a, c, g, or t
  misc_feature (1027)..(1027): n is a, c, g, or t
  misc_feature (1166)..(1166): n is a, c, g, or t
  misc_feature (1219)..(1227): n is a, c, g, or t
  unsure (1)..(1236): unsure at all n locations
ggccacaaaataaaccctatntaacatattattaaatttgaatanttnttgcaaaaanttctcatcttttgtggggtccttcgagttatattttttgattgccaataagcctcactgttngttctcttattatgcnnnncccatggtagtgattgtggcatagtgaatgtgaacatnncnactaatggtgctgaaatnnnnnnnncnnnngnnnnnnnnnnnnnnncnnnnnnnnnnnnnnnnnnnnnnnnnnnnnnnnnnnngnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtnnnnnatgannanttagttagannnnnnnnnnnnnnncannnnnnnnnagnnnnnnnnnnnnnnnnnnnntaggnnnnnggagacccannnnnnnnnnannnnttggnnnnnnnnctccagnntttttantgcacactttgcaactgcaagtctgcaacacatctttactggatattctttttagtatgtactacctccgttttcnaatatttatcgttcgctagttcatttttaaactaaaatgcgacaaatagaaaagaacggaagnnntagtaaaatancgaatatacatnagaattacatgcnttacaagtaccctttgttctgaacttctgattgtcccactcatctgtgggttggtatttgtaacgattcgttactgcaaaggttgcaagttttctgtcgnaaggacaattttcagttcgantttttttactaacacccattcnacacatttgcagtacaatcaactatgggagcgagctacctctagcccagggaatcaattttggttaatcctgcagaaatgttgcgcgtggatctcagtgttttctgcagacgtggatgccgtanggaaagaactgatgcaaccgcatttgagatctcagcagacttgagcagcatttattggcgtcagttgtgaaacttaaactgcaggagcatcttgtacataaataaaataagatgtttgttgctcgtgggccgtggcacnttttggtaccggtgtccagtctactaataaaatctaatgcaaaacggtcatannnnnnnnntcatgcagt

SEQ ID NO: 304 - DNA, 669 bp, Zea mays
  misc_feature (1)..(6): n is a, c, g, or t
  misc_feature (9)..(10): n is a, c, g, or t
  misc_feature (72)..(79): n is a, c, g, or t
  misc_feature (139)..(139): n is a, c, g, or t
  misc_feature (186)..(186): n is a, c, g, or t
  misc_feature (263)..(263): n is a, c, g, or t
  misc_feature (265)..(265): n is a, c, g, or t
  misc_feature (416)..(416): n is a, c, g, or t
  misc_feature (457)..(457): n is a, c, g, or t
  misc_feature (464)..(464): n is a, c, g, or t
  misc_feature (508)..(508): n is a, c, g, or t
  misc_feature (524)..(524): n is a, c, g, or t
  unsure (1)..(669): unsure at all n locations
nnnnnngcnnccctgcgtcccccgagcaaagcagaacaaggggggaaaaagttgacatacgcttgcagcgannnnnnnntgccgcccgcgccgcgctcgtgcgcgtcctccctccgcgaccatcgccgacctcccaacngaagcagctcaagcaaggtacgtttcgccgccccgctcccactgttngggtcccgctcgaaatgccgcgacacagagctaaaaccctagtttcggttttgcaccccaaggtctaggcggccgcngngggtcctcgctcgccgttcgggcgaaggactccgatgacttcggggcccttctgtcggagaagctcgatgcgcaggcgcctgagaagcgggatgggcgggagggttttgggagggaggcgagtagcgtggaggaggagaaggaggtggtgnaggtgcagggcgagccggcttcgtggggtgtgctcaaccanatcggcntcgaggtgagcgcgcgcatccgattgcttttaaacttgtcgtgntgccgtttcaaaatgngtgtgctggattgaggtgaaaatgttttgtacttttgtgtgctcgacattttgttactgaaacaagaggaaacctgctctcttcattcagtaccttggttcagagaacaaggtttgtagatatcgcgtcagtattcaaatgattg

SEQ ID NO: 305 - DNA, 1308 bp, Zea mays
  misc_feature (102)..(102): n is a, c, g, or t
  misc_feature (104)..(105): n is a, c, g, or t
  misc_feature (153)..(153): n is a, c, g, or t
  misc_feature (159)..(159): n is a, c, g, or t
  misc_feature (209)..(209): n is a, c, g, or t
  misc_feature (247)..(271): n is a, c, g, or t
  misc_feature (338)..(350): n is a, c, g, or t
  misc_feature (434)..(435): n is a, c, g, or t
  misc_feature (487)..(487): n is a, c, g, or t
  misc_feature (705)..(757): n is a, c, g, or t
  misc_feature (759)..(759): n is a, c, g, or t
  misc_feature (785)..(800): n is a, c, g, or t
  misc_feature (817)..(825): n is a, c, g, or t
  misc_feature (827)..(829): n is a, c, g, or t
  misc_feature (840)..(841): n is a, c, g, or t
  misc_feature (863)..(865): n is a, c, g, or t
  misc_feature (871)..(875): n is a, c, g, or t
  misc_feature (883)..(885): n is a, c, g, or t
  misc_feature (898)..(907): n is a, c, g, or t
  misc_feature (1117)..(1140): n is a, c, g, or t
  misc_feature (1306)..(1306): n is a, c, g, or t
  unsure (1)..(1308): unsure at all n locations
tgcctgcaggcattatggctggcgtggactccggcatttggatggatgcacatccaccagcaagatgacaaggacccaacaggcaacagggcagaggagagnannggcgcaggagtcatggagcgaaacgcctcttccaatgctcatctgtcnatcgcnggcgccgggcggtcctgaaacgaagctcaccaacaccaaccatgccgggngggtgccgggtgcgcgcgtgggcagagtggcgctggannnnnnnnnnnnnnnnnnnnnnnnnagaggtccagccctagccccatgcccctcatccccagtcgggcctggctgcgtggcatgccggcttnnnnnnnnnnnnnaccggcaagtgcaagccgtcagcacgtgcagctctgctctcgtacctaaagagtcacatgctcctccgactccggtgccccccnnaccccaaaaatctcgcattgatcgccgcacattttcgatgcgagagcacagncgcgtcagatttaaaaatagtccggtgcggtggagcacggcacggcggagcggagcactgtacagtcacgaggccgtgcccagagcgcagcgtaacacgacaagagagggtttggtatagcagacagcagtatccctttacagttctagccccaaaaaactcttatgagccctgctacttgggggccgtggggttagcggcagcgccttctcgtccgnnnnnnnnnnnnnnnnnnnnnnnnnnnnnnnnnnnnnnnnnnnnnnnnnnnnncnccgctccgcgcgtcaagctctctgannnnnnnnnnnnnnnnaaataccagcttcgccnnnnnnnnngnnnggttccgtganntctagagggcgcgtcggggctnnnggagcnnnnncgctgggnnncgtcgtggccggnnnnnnnnnncgaggggcgccggacgcaacacaccagcacaggagcggcgagtcggaatcgccggacgtggagcaggctactcgaggctccgagggtgtccgcgtggcgaacaacgagcggacgtagtagttgcggtagatggggagggcctagcgctagccgcccagccccgttccggcatgcactccggccgacgcgtctcttcccaatcccacaacnnnnnnnnnnnnnnnnnnnnnnnngcgtgcaggtgcagtgcctttgccattctctcgtctctcctcgcatcgatggctcgacgcatctttctccaccccggcagcatccttgtctctatccctctttctacctactccgctccgtcctccgttggggccggcggggccctgagctgagacgagtccaatngg

SEQ ID NO: 306 - DNA, 434 bp, Zea mays
  misc_feature (99)..(99): n is a, c, g, or t
  misc_feature (132)..(132): n is a, c, g, or t
  misc_feature (152)..(152): n is a, c, g, or t
  misc_feature (175)..(175): n is a, c, g, or t
  misc_feature (232)..(232): n is a, c, g, or t
  unsure (1)..(434): unsure at all n locations
ccaagataactgaagattctacatttgataatgatgtgttttctttccaaccccacttaggttctgaacaaacagggttctctactgcagaaaaggtgntttccttgattgttagtatctacctgtattttncctcctttttgcagtgcagngttataatactatttggcttccntctattgccaacctcactacaaaatttcctctttttgtttttttggtacaaagcacnttttaattgattcatgtgccagaaaaatgttttttatctacaggactatggtgcctatgagaaaaagcagtccttgtcgaatattcatcagcaggaatccagtctccagtcaagctttaccgcagtcaaggataacactagtgcaacaattgttaaagcgaagccatcttctagttccatgttcagtgatagtcactattca

SEQ ID NO: 307 - DNA, 732 bp, Zea mays
  misc_feature (143)..(143): n is a, c, g, or t
  misc_feature (184)..(185): n is a, c, g, or t
  misc_feature (454)..(454): n is a, c, g, or t
  misc_feature (653)..(653): n is a, c, g, or t
  misc_feature (662)..(662): n is a, c, g, or t
  misc_feature (677)..(677): n is a, c, g, or t
  misc_feature (684)..(684): n is a, c, g, or t
  misc_feature (697)..(700): n is a, c, g, or t
  misc_feature (719)..(721): n is a, c, g, or t
  unsure (1)..(732): unsure at all n locations
gactcactcaccttctttcttagcctgcttttccttgcagcctccctattctgggccagccttctcagcgtctgtacgtgttcattacagcgtgcgtggtgcacataaccagtacgtaatcaaaattagtgcaacaaaacatngatgactaaccagtatagtgtgttctttccaagtatagtanncgtagaactaacaattaaataattcatcataactgacacttgagagtatcacaatccatttacttttgggtcgcgttcagtggtcgatgtgcctctcctatgatccttctgcatcaaccacaaaaaaaaatggagaaaaaacagtaacgcagccatggcaattaaaacagcctcaaattaatacaacaaacattagcagcttgtagtaccaaattggtaggattattattcaagtggagcactagctagtagttaaccactcaccttgnccagtggcttgacacctttgatcatcccgggtgctgcagccggctcagcagaggcagcaaagggttggtgctcctgctgcctcctgctctccgccaacaactcctccatggccgcatgctggtgatggtgatggtccggtgacctaggctgcttggatcccaccggcgccggggacagaactaaactaatctccccctnccaatcgcntcagaaattaaaacnggtcagntaaacaaccaatnnnngcaaataagtgcaatcaannnccatgacagca

SEQ ID NO: 308 - DNA, 731 bp, Zea mays
  misc_feature (258)..(258): n is a, c, g, or t
  misc_feature (260)..(260): n is a, c, g, or t
  misc_feature (485)..(485): n is a, c, g, or t
  misc_feature (718)..(720): n is a, c, g, or t
  misc_feature (725)..(725): n is a, c, g, or t
  unsure (1)..(731): unsure at all n locations
tacccctgctgaccgagtggggggcgctttctctcgagtccctcaagaaagagctcgcagaggccaacgcgcaccgggacgccgctctgcgcgaagctgccgaggtgaggtcgtcgctgggggagctggccaccaagctggtgagcgtggaagcgtactgctcggagctcaagaaggcactgcggcaggccaccaactcgccgtccgtctcgcggagatcgacgagatcagtcgaagcaagacgagagctcccgacgncngtgagccacgaggtaatggtagaaggcttcttgcagatcgcgtcggaggcacggctctcggtgaagcagctctgcaaggcgctgatccagcaggggaacgaagaatcctgtgacggcctgtccgacaggctgaacctgctcctgcgcccgtaccagctcgcgctcagcggcagcactggcaagcactgctcgaaggccacgctgtaccatctcgaggcgatcatnaaccaggccatgttccaggacttcgagaaccccgcgttccagcggaacggctcgccaaggtgcctcgacccagcggaggaccgccagcagagcttcgccgccttcgtggcgctgcgcaaccttagctggaacgaggttctgcggaagggtaccaagtactacagcgaggacttcagccgtttctgcgaccggaagatgagcggcgtcgtggcgacgcttggctggtcccggcnnnggccngagcag

SEQ ID NO: 309 - DNA, 768 bp, Zea mays
tatgattagttcatttgctgtaggacactggactcctgtagtcgtccaacagcaaaaatccattttctctgtctttctgtgaaagccagaaagtcagagtgttctttttaataaagaatgcttttattgatttcaaaacaattacatcaattgatacaactatcttgactcttgcttccaacctctgcatttagaatgcacacagcccacacagcgttttgaaataaaacagacagactggctcaatagatgcaagccatgtatatctttcagcgttttgaatgtccttcttgatgcaagccatgtatgtattactaaaggttaattggtggagtaacttaccttggtatgccccacaaaaccaaattcctctgtttccttgaatgtgatgaagctcaagagaagcctttgcggcagccacagatgggacagggtggctagtgtaccatttaagaaagacgtggtctgggacatgaggaggattcagcgtcaccagaaaaggtctgcttgtagattctatgttctagaaaatattccaataaggatctattaatcaaagtacatagtggcatagtgctatatacatacatatattaagtaacaatacattgctaattgctgctatccatgttaaggcaaggtaactacctgaagcagatttagccagtaggttacacaaacccccttgcttgtcgtccccaggaagttccaggaactccaagcagacaaactccgtggcatcaaacttttatcggagtggaggtatat

SEQ ID NO: 310 - DNA, 394 bp, Zea mays
  misc_feature (343)..(343): n is a, c, g, or t
  unsure (1)..(394): unsure at all n locations
acggcccaccgggcggggctgaagctgccggcgtacaccacggtgcgatcgggcccgggccactcgccggtgttctcctccaccgtcgagctcgccggcttgagcttcgcgggcgaccccgccaggaccaagaagcaggcggagaagaacgccgccatggccgcctggtcctcgctcaaacagagtacgtcatcggcccaatcccgaaaacacaaaccttgcgcatatctttacgcgtcacggggcatcattaatggcccccgccatggtctttgcagtgccggaggctcgcaaggagcccggcgccggcgacgagcaggagcacgtggctgtcgccagagcnctcgcggcgctgaagccgcgagacggcggcgacggaaaggcggcgccgcct

SEQ ID NO: 311 - DNA, 731 bp, Zea mays
  misc_feature (104)..(106): n is a, c, g, or t
  misc_feature (183)..(206): n is a, c, g, or t
  misc_feature (470)..(470): n is a, c, g, or t
  misc_feature (474)..(474): n is a, c, g, or t
  misc_feature (476)..(477): n is a, c, g, or t
  misc_feature (479)..(479): n is a, c, g, or t
  misc_feature (485)..(485): n is a, c, g, or t
  misc_feature (489)..(490): n is a, c, g, or t
  misc_feature (492)..(492): n is a, c, g, or t
  misc_feature (605)..(610): n is a, c, g, or t
  misc_feature (615)..(617): n is a, c, g, or t
  misc_feature (627)..(631): n is a, c, g, or t
  misc_feature (644)..(644): n is a, c, g, or t
  misc_feature (647)..(649): n is a, c, g, or t
  misc_feature (658)..(658): n is a, c, g, or t
  misc_feature (666)..(677): n is a, c, g, or t
  misc_feature (679)..(692): n is a, c, g, or t
  misc_feature (695)..(695): n is a, c, g, or t
  misc_feature (697)..(702): n is a, c, g, or t
  misc_feature (714)..(725): n is a, c, g, or t
  unsure (1)..(731): unsure at all n locations
tgcagtggcgcatgcatgcgcagaagagcagccgctacaaccaatccagacgatgtcgtcgggatctagtcatctttttcttctcagtaatgcatggcgattannncgccactgttcacacctgcacacatgatcggatcgtccgaggctttctgggttcctacgtcagttggtagtatttgnnnnnnnnnnnnnnnnnnnnnnnngtgtttgaggaaacgtaggacgtcgtcctagctaataacatctcactttctgtttcgctccctcctttctccccatatgattgatctttacctactgctgcacacacacgccttttgcttccatgcctgttctcagcagccaccgtctctgggctaggctcttgctgtttgtttaaggaatagacatggcatgtcaagtgagctgacagccttgttggccggactggactttgtgaggcagatgccctcctaacccaaacctcnccantnncnactgcnactnnanctagctaggcctgagcaggtcgatgtggacagagcgagcgcgcgcgcgacagcaaaccgacgagaaagaggcgatgggtggggcttggcttgcttgtgatagggggaggattnnnnnnttgcnnnttcctacttnnnnnctggcattgcatngcnnngcatgcctnctgatgcnnnnnnnnnnnntnnnnnnnnnnnnnnatncnnnnnnacacctgcatgnnnnnnnnnnnncgtacg

SEQ ID NO: 312 - DNA, 478 bp, Zea mays
  misc_feature (75)..(75): n is a, c, g, or t
  misc_feature (125)..(125): n is a, c, g, or t
  misc_feature (161)..(161): n is a, c, g, or t
  misc_feature (313)..(313): n is a, c, g, or t
  unsure (1)..(478): unsure at all n locations
tttggtactcctacttcggtgtagtttgatctttgacgatattccgagccttagagctactaatactaaagctanattcatgcactttaggggcatgttcgaaaactagttatgggtgaaatccngccttttggtgcttatttaagatattttgctgctgncagattctgcttgtgaaacacatcgaggacgtactcgaccatgctttcgaaggcggatgtccacttaaatcacgctccaagttatagcatccaactcgcctttgctatggatatttgcttcggaggatcatcgtcaacagtaccacgaatgntcaacagtcagaataagagcctagctctcttgccagcacaggtcttgacacgcccattttggttaggcttcgcatctgaatgtgtatactggtcagaattcggagagcagtcagaagatctgctcgttcacctgctgggactcattgcatagtttctcgacacca

SEQ ID NO: 313 - DNA, 562 bp, Zea mays
  misc_feature (4)..(12): n is a, c, g, or t
  misc_feature (60)..(60): n is a, c, g, or t
  misc_feature (159)..(159): n is a, c, g, or t
  misc_feature (294)..(294): n is a, c, g, or t
  misc_feature (441)..(441): n is a, c, g, or t
  unsure (1)..(562): unsure at all n locations
cagnnnnnnnnntcatctgattctgaatcatccgatgaggatgaccctggaaggatgtcngtgtctggcgaggagaactgtgatccagatcctaaatttatcaggagcacttcattcaaggcagatctttttaggtctagcagaaccccagaggacttngccacatggcaacgcattataaggttggatgccatccgatcaaacagtgaatggattatgttctccggcaaccaggctgaagttcccaaggagagagcattgcagtctgcagcatctgttgggttgaaagattangatcacttagagcccaatatgatttatcacgcggctcgattagttgggttgcttgaagcatatgcggtgtatgatccagagattggctactgccaaggtatgagtgatctgttgtcacctatcattgcggtaatggaggaggacgangaggcattttggtgttttgtgggtttcatgaggaaagcaaggcacaacttcaggctcgatgaggtcggaataagaaggcagttgaagatcgtctctcagattatcaagcgcaaagattcac

SEQ ID NO: 314 - DNA, 590 bp, Zea mays
  misc_feature (97)..(97): n is a, c, g, or t
  misc_feature (355)..(355): n is a, c, g, or t
  misc_feature (431)..(431): n is a, c, g, or t
  unsure (1)..(590): unsure at all n locations
caggcttgccgcctctggccattctcaatgtgtgtgaggtaacagacgggtcactggaattagtgtagtccactgtagttattaattttttccagtnaaaaagctcaaatacaggtgtaaaattattagatttacaactcattcaggatcacgagaaacgaggagcgaggtgagcttgatttcggccggcaaataaatgtggtccactgaggtgattttttctagttggaaaactcaaataaaggtgtaaaattaatagatttataactcatccaaacaagtttttcagcttgacctgtaaaaattgctggaactgtattttaaactggtattagccataaaactggttaaatgntaacaaatgcaattttcatgctatcatatttgtttcctattgtacaggttctaccggcctgacaataacatatcanttttttcagaacgatgaaaagtatagctgcagcgaaactggctatcgcctgcccttgaaatgtgtacaggcacaaaatgctacaaaagaaggaaacatgagcaagcagaggaagatattggatgatgcatccacatcaggtggcacaaaatccgcatca

SEQ ID NO: 315 - DNA, 272 bp, Zea mays
  misc_feature (216)..(216): n is a, c, g, or t
  unsure (1)..(272): unsure at all n locations
caatgtccaagccatcatagcattaggctgtgcaaatgacacggtcctaccataccggtgcataatgtacagattgagctcttttttatcctataatacgagtcatatggtacacatgtacttgttctacatcagggttagtatgtacagtaggaaaggacaatcctctccagctataactaacttcctttgaaatatttactgaaagcttcctcntccttgcagtgcacccacaagaccttgtacacctcaattagcaactttggaaatcg

SEQ ID NO: 316 - DNA, 604 bp, Zea mays
  misc_feature (1)..(1): n is a, c, g, or t
  misc_feature (579)..(579): n is a, c, g, or t
  unsure (1)..(604): unsure at all n locations
nagttcatgttgttcattccttattgccaccttttaattttcaagccctgcttgttgtatacaatatcagctaaaagataggaaaaaccttcttccattcttgtattgtgtagtctgtctccagtgcagaagttttattgggcattgaagctgcacatttattctgttactacactacagtaatgtattaatatttctcatgatggagtgtttttattaagtgacagaaaaaatgctatgccatgcatatctttgcatcattgcatgtgcattttgttttctgaggattaacatcatcttttgtgtggagggttggtgcaggggacactatagtacgatgaaataatagatggcttctccttaacagcagtgaaacttcattaacatttggagttagaggagacagtagagtacataatagatggcttcacttcattgacatttggagttagagaactcacttgtgagagacctgacttggcacatgtggttatttttaagcctgaaaaatacatttaaatggttttgaatcagttcctgggggagttctaatgctaaggactagttttcattgacaanttcaaatggaaatagggcatgtgct

SEQ ID NO: 317 - DNA, 589 bp, Zea mays
  misc_feature (300)..(301): n is a, c, g, or t
  misc_feature (349)..(349): n is a, c, g, or t
  misc_feature (351)..(351): n is a, c, g, or t
  unsure (1)..(589): unsure at all n locations
tatcatcacgacgaaaatcgtacacatataatccaaagctaatcctcagaacccctaaaccctagaagaataagtcgaggtgataatccaaaggctaatcctcagaacccctgaaccctagaagaataaatcgagcacaatggaaagcaacgcttgaaccgaataactagctgcaaaagtcctactcgaaccaatcaaagcaagcaattcgacgaagcaacagcagcgaaccaatcaaagcaagcaattcaacgaagccactgcattagcgaaccaatcgaagcaagcaatccgacgaannaacagctcacacagttggaacgcctcgacccgcacgcgaatgacgaananggaggacgccgggcggaggataacggggtcactagagaaattaacaaaatccgcacggattgatcgagcaaccggaaaatgcggaggggttttagagcgtgactaacctccttggcacggttctcgatgaggccgatcacgaagctagaacgctcaccacttcctcctccgcctcctccgtcagctccggtggcgtcgccctccatctccgcggcgttgagccgggcaccgcaggggt

SEQ ID NO: 318 - DNA, 350 bp, Zea mays
gagggaacctggggaagcttcacggtggtggatgcggcgacgatggcgtagccgagcagcttagagatgagcgggagcaggcagcccttgtcggggatcttggcgtcggacagagccgcgaggacgcacccgaaattcatgcctaggacctcgagctccatcgctgccaccatggccgtctctctcctcctccgtcgccacggaggttcagttgcagcttgcgtcggcaatggtgagtggtgacgagacgacgaacagcgaagaagcccacggcccacaagccacgcgcccacaagccgaccagcgtatctcttcagtgagatgggccttttgtgacgggctggacgtct

SEQ ID NO: 319 - DNA, 1237 bp, Zea mays
  misc_feature (27)..(27): n is a, c, g, or t
  misc_feature (36)..(36): n is a, c, g, or t
  misc_feature (749)..(753): n is a, c, g, or t
  misc_feature (829)..(829): n is a, c, g, or t
  misc_feature (975)..(975): n is a, c, g, or t
  misc_feature (978)..(1041): n is a, c, g, or t
  misc_feature (1075)..(1075): n is a, c, g, or t
  misc_feature (1102)..(1102): n is a, c, g, or t
  misc_feature (1117)..(1117): n is a, c, g, or t
  misc_feature (1225)..(1225): n is a, c, g, or t
  misc_feature (1236)..(1236): n is a, c, g, or t
  unsure (1)..(1237): unsure at all n locations
tgtactcttgttgcttagatcttggcntggaccagnctactgctgcatatcttcaatgctttgtatgacacctttggtccactttgatgaattaactgattttgtaatgaagtctatgaactaccatatgaatttgtttggttatctttgctagtgccccactttccattgccaccatcttgactgtattttatttgtaatcatagatgcgcatattcacgcttttttcggatgccatttcttgaacaggcttgatgccaaaccaacccgacacaacagcagcaaaaaggggtaattgctgcatctgccatcgaatgcaagttgactctctactttacaggtaatgatttgcagggacagatcgcgcagtacttcgagcaactttaatcaacaagtcatatcttatcctttttatgattagtaacacatttgtctacaagaacctcagacataataatagtacgaagtgcacaagttgctgcattgaagtgcttctaactgcattctctatgatgcatcaggtgtgggcatgtgtgcacctgttttgactgcgccggtcagctgaaatcgagcggcaggagttgcccaatatgtcagactcctattgatgatgttttccgggcgcagctgaatttttgagcttaggatttaggaaaggccaagagaaaagagccggcactcccagatttagatgtggagtttgcgaactgcgaagccctggtattgaggaggcttcctaccttttgttnnnnnccactaaaaaatacgagctagttcttgcagaaatgtaaatatgttttttgcgcaagagcggtatgcttgtatttcnctgaaggaaaacagagttctaatcataatactgatcctgtttctgatggttttgattgccctaatggaaacgactttggaattcaatcagcatgctgcatgcagtaatagcaagtacttcaaattaaaagttcagaaaccttaagngcnnnnnnnnnnnnnnnnnnnnnnnnnnnnnnnnnnnnnnnnnnnnnnnnnnnnnnnnnnnnnnnngtcaaaatcactctcaatccgtattaatcccctncaatccatatggattgaaaataaccgnacaagctctaacatngaatcgctggacaacagaccttggtttgaaaaggccaaaatgctgtggttgcctcggtgtatgcaactagcacgtcgggttacccacactgaaattctctccggcccntcacacctgcng

SEQ ID NO: 320 - DNA, 475 bp, Zea mays
aagaaaacacaaattaacaggacaactgctagcttgaaaaagaaaataactttgttctgatacggtactcttctcaaattatccttagaaaggataaaccttgggtgagctaaacaactaaaaaggagtcattccttcaacatttattcaagcaaaggtagtaaaaccgcgcaagatcaagcaagtccccatgttcccgcctccatccgtagtcaatccacataaagtgtcaaaatttctaacctcccactcccaattcctagctctccagacccctgagatagaatagccgctgaaaagaagtaccgcacattgaccgcaagaaaccgcgggcctccgcaccaccgtaccttcggcaaagttgacagaatgggactcgtcctcgccggagacctcccctgaacagatcttgagcaggtactgctcgaggcttttggcaacgtccacctcccaatttgactcggggtccctattc

SEQ ID NO: 321 - DNA, 528 bp, Zea mays
  misc_feature (110)..(110): n is a, c, g, or t
  misc_feature (118)..(118): n is a, c, g, or t
  unsure (1)..(528): unsure at all n locations
cttctcccgcaaggtcttcttgtgttcaagcttgtcctccttgtcgtgtttccgcatttctctcaacatctctgcataccgctgggaaactggagcaagagacaataagnaagttcanatttagggttcacatccttcacgcaaattattgacgacaaagaaacagagacagaacagacttttatccttgtgaaccacaggttctaaagatacttcttcagcgacagatgcaagaggtgggatggcgttgccctcatcatcatacttgacccttgttcctgatggcctgttcacgtttatcttcagtttcttctttttgaagggtctttcaagtctgacaaagacaactggttagcataacttcggcaaacaaaacctggaactaaatattcggtagcatcaaatttcaaaggtagaaatgtcttagtttgaaaattgagttgcatggtacatacccagtcacatttgtatctgtggcagactccttgggatgaaggacatcatcaagtctgtcatccatattagcat

SEQ ID NO: 322 - DNA, 636 bp, Zea mays
  misc_feature (43)..(268): n is a, c, g, or t
  misc_feature (273)..(273): n is a, c, g, or t
  misc_feature (276)..(276): n is a, c, g, or t
  misc_feature (289)..(289): n is a, c, g, or t
  misc_feature (503)..(505): n is a, c, g, or t
  misc_feature (526)..(526): n is a, c, g, or t
  misc_feature (537)..(551): n is a, c, g, or t
  misc_feature (554)..(556): n is a, c, g, or t
  misc_feature (560)..(564): n is a, c, g, or t
  misc_feature (572)..(576): n is a, c, g, or t
  misc_feature (583)..(584): n is a, c, g, or t
  misc_feature (586)..(591): n is a, c, g, or t
  misc_feature (593)..(632): n is a, c, g, or t
  misc_feature (635)..(635): n is a, c, g, or t
  unsure (1)..(636): unsure at all n locations
gcatgaatgatggaacggacttgttgacacacttttagggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtnttncctgtttgcaagngtaatggcaccggattcacaagtttgcgctgcatttctctgcgttcggtacaatggtacatgtgtacaatgaacagaaaaatagtattagtcagacttcctcctgcatttacaccggttctaaactagagccagttttcttccatttcctttgaattatccattttccaccagccacaccttttatatagatgctgtctcgaccatatgaacannnttcttgctagataggagagtnccatacaaacnnnnnnnnnnnnnnngcnnnatcnnnnntgatgatnnnnnattaccnncnnnnnngnnnnnnnnnnnnnnnnnnnnnnnnnnnnnnnnnnnnnnnnttng

SEQ ID NO: 323 - DNA, 681 bp, Zea mays
  misc_feature (45)..(45): n is a, c, g, or t
  misc_feature (62)..(62): n is a, c, g, or t
  misc_feature (484)..(486): n is a, c, g, or t
  misc_feature (489)..(493): n is a, c, g, or t
  misc_feature (497)..(502): n is a, c, g, or t
  misc_feature (504)..(504): n is a, c, g, or t
  misc_feature (506)..(557): n is a, c, g, or t
  misc_feature (560)..(562): n is a, c, g, or t
  misc_feature (564)..(564): n is a, c, g, or t
  misc_feature (570)..(580): n is a, c, g, or t
  misc_feature (582)..(584): n is a, c, g, or t
  misc_feature (588)..(590): n is a, c, g, or t
  misc_feature (595)..(606): n is a, c, g, or t
  misc_feature (608)..(619): n is a, c, g, or t
  misc_feature (621)..(625): n is a, c, g, or t
  misc_feature (632)..(632): n is a, c, g, or t
  misc_feature (635)..(672): n is a, c, g, or t
  misc_feature (675)..(680): n is a, c, g, or t
  unsure (1)..(681): unsure at all n locations
cttaatttaattgtcgacaagatgaagtttcaataaaaagaactntatcgtttatttatttntttgctctactgtgctaatattgtgcatcactgcactggttcaacagtatgctgcttcagtatttttgttccgtaatgctatatgtattttgtgacagttgtttcttagcaaaactgctattagtagaagtaattattgtactaaagtttgattaacttagtagtgctctctccatttcataatgtgtaaggcatattagatttcctttaagaaataaatgaccttcgaatagtaaaaatacatgtagattcatatttcacatgtttttttagtaattgagaatgatttcaagataaattaatggtgaaagtataccttgaaagacttctccaaatcctaatatgcattgtaaaatgaaaatggacacaatagtttaccacaggacaaactgtccacctggaatttaaaggtacaaatattnnnagnnnnnaaannnnnntntnnnnnnnnnnnnnnnnnnnnnnnnnnnnnnnnnnnnnnnnnnnnnnnnnnnnatnnngntctagnnnnnnnnnnntnnnatannntgacnnnnnnnnnnnnannnnnnnnnnnnannnnnggatctnatnnnnnnnnnnnnnnnnnnnnnnnnnnnnnnnnnnnnnncannnnnnt

SEQ ID NO: 324 - DNA, 168 bp, Zea mays
cacaagacgagcagcaaaagatgtctgtggtgaaaggagatcatttggtagtttctcaacacgtaattctgttatactgggaaactctcctctgcaaagggttgatctaatgccttatggaataaagatttccatcaaattttgtgacagcttcatttggctttgggg

SEQ ID NO: 325 - DNA, 476 bp, Zea mays
  misc_feature (1)..(2): n is a, c, g, or t
  misc_feature (196)..(196): n is a, c, g, or t
  unsure (1)..(476): unsure at all n locations
nncgccgagatgtgtgttactgctcacacgcttcgcggcacgcacgtcctgtctgaacgtgagcggcagggcccggggtggcctgctgctggtggtcacagattcagcgtatatatgcactgaatgtaacgacgtccagtgacgttagtgcccttcatgaacgaacatacccgacctcccaccagagatctttttngagacgtgagctgtggtcgcattaaaggctgttcttgtacagcactagtacaaagcttcataaccgttttctgggggggtctggattaaacaatctccgtaacagatgccctcaatttgtccaataacttagacaagcaatcccaataaaacagtggcgtgcgtgcgtgcgtgtcctttaatccaggccttgctaagcttaaccgggacaagcgaatccagggcaggtgctatgctacctagctagctaggcgacgcccatctcggttcttggaaaccag

SEQ ID NO: 326 - DNA, 398 bp, Zea mays
tgacttcggcacagtggatgacattttcaaagcttgcccttcaactacagtgtccagttatatcattcagaaaacaacaagaaaggctccattcttttcaggcaaataaaaaccatgcaatttcatggcccatccattagtagattctcttctcaattaatagcaactctttattgaccattttataaacaataacactaatgaacaatctgcacaaacaaattgggatgtgctttcaaactcctcttgtaaaaagtcacaaactcacaatagtaaataggagtaggaagcatggggttattaggtcagtgatcagataaacagatctagggggtatttgaatgcactagagctaatagttagtggctaaaattagttgaaacatccaaacaccctag

SEQ ID NO: 327 - DNA, 1619 bp, Zea mays
  misc_feature (1148)..(1173): n is a, c, g, or t
  unsure (1)..(1619): unsure at all n locations
caaatgtacacatatagaactttctggtgctctggtgctcttactcttcagaccatagacaatggccaccgaactagatgtgagcaagtctcgccgcttcgacattgccatgtcgaggcgaactcggcgatcaacaagcctggtagcctgcttccaagatcagtatacaccgtccctggcacatcatcgccaccaagagctgaaggcatttctgcaacgccaagatgaagagctgaagtcactccagcaatgccaagaggaagagctgaaggcactccagcaatgtgaggatgcagagcagaagacactgtgtttgaatgaggatgaggatctgaagattccacaagcaccactgcagtatgaagatggtgaacaaaagacaccggagcaatatgaagatgagcacaaggaatcacagcagtgttcagacgaagagcaggagataccagatacatatcaagatgatgagaagaaaccagaccaggaccagtatctaaatgaagacaagatgccagagcagtatcgagctaaagatgagttaccatcacaataccaaaaccaggagcttatgataccaaacctacctgagaaggagactgcatcagagcgattccaagaagcggagcagctggtgacaccaaacctacctgaagaagatgaggagactgcaccaaagcaattccaagacgaggagcagaagggacttcaacaacaccaagagccggatgagcaggcatcgcaacctgaagagcagaagtctcagcaggaatgccatgagaaggcaccggagcaattccaaaccttgaagaagctaggcgcgccaccacgtcttgctgacaacgtgccccggttctcccttcaggagcttatacaacagaagcagcttccgaccggcgaggcgatgcctgccagaaagcaaggcagccgtggagagagtgtcctcgctgatcacaatgtttcaggaccaggagcagcagcagggggcacgacactggccatggtgataaagcgacccgagggagggaagaagtcgatgggggtgatacgccggtgcgtgaaggccctgaacgggatgatcaaggccaagcacagttccaagaagaacttgcatttctagctttcaacagaatccaggagaccaggagtannnnnnnnnnnnnnnnnnnnnnnnnntcagcactgatgagtaagtgtggtccagagtttcttagtagaccgcacatctctgaataatgcattcgcagttgcgcagaaccaaaattttgagtatgatgcgcagggtgtgcaagatctggcgagaaactccagggctttttacgccctggtctacactgtctacctatagcaataaactgtggtagttttattagctgaatatcacaaatctgttcctcctatgcgagaagatggtctgctaagtccaagagtagagatcaggctctgatcatgtgctgttgacttcctctgcaaaagcttgtttgcttttagaagtgtatgggtgtgattagaaaaggtggaaaatgatcggttctacttctaccgacacctgccccccaggtcggcagcggttttggtgcagactccttttctgcctttctgtgccgcgtcccgtttaggtt

SEQ ID NO: 328 - DNA, 503 bp, Zea mays
  misc_feature (224)..(224): n is a, c, g, or t
  misc_feature (236)..(236): n is a, c, g, or t
  misc_feature (341)..(341): n is a, c, g, or t
  misc_feature (469)..(469): n is a, c, g, or t
  misc_feature (471)..(471): n is a, c, g, or t
  unsure (1)..(503): unsure at all n locations
ttatgtctcagcagcaagctcttctaatggctgctcttaaagctggaaattcaccacaaatagttccagggaatgccaatcaactaaacactaacgtttctaatccccctcttggaaccttgcctttccaaaactggacaaatcttggctatcaaaatcctgggttgactctagcagcagcacagaatggtgccaccaaggttaagagactttatatgtatatnttttttggcacnataatatccgaataatattttagcatgtgctatatcttcctctgttttactgcctgacaggtttcgaacaacaatcaagacctctcttctggtacctttggtttnggcacacctgggtaagctatactgcctgctagttgcagattggcggtcgctggaatttcatgctgcaccaaattggattttagagtaatgaactcagtagttgatcttatgtccattttgctgacatntnctgttgattgcaggatgcacaacattactcca

SEQ ID NO: 329 - DNA, 402 bp, Zea mays
gtagccgcagccgcagccgcgctttacatcttacttggcaagttggcatgtacatttccacttccgccaccttctccttgcctgctgtagcgtcctctgcttcagccatgtcgtccgtgtccggcatgccgaacagcttgcccatctcctccagcgtccggccgcgggtctccggaaggcacgtgaagaagaagacccacgcgacggcggcgatgccggcgtagaggaagaagctgccgccgattgtgatgcctttcgagagggacaggaaggtcatggagatgacggcgctggtgacgcggttgctggccacgcccacggcgaagcccagcgcgcgcacccgcagcgggaatatctccgaggtgtacacgcccgtgatggggccgagcccgatggagaaga

SEQ ID NO: 330 - DNA, 447 bp, Zea mays
agatgaggtccaatccttaacgaaatatcctatgtacctgagtttgtctcttgatcaaagaatccgtccccgccatcgttttctggtttccttgaagaaagctccaaagggcccatttcctctgagctcctttgtgcccacagatgagcgtttttgccagaggtgggctgggactagcttggaggcataccatacattcagacagaggttgctgctaacaagtttcacagagaagtctggaaggaaaacactagtctcaagacggtagatgcctaggtggtgggagtttgtttctcttgagcccacgctcctcctaacagtaagatgatctctttctgattttagagtttgtttggtagcagtctgcatacgcatagtactgattagtgattagttcacagttctcaggaaatgggcttggttgctgacttggtacttgatgttcac

SEQ ID NO: 331 - DNA, 496 bp, Zea mays
ttgctcctacagataatactactacatctcatcaaaaagcagccaatctgccacgttttgaaaaagggcttatacatacacaagcgggcgtatagatatgagccgtcgaggcagaccggcgcaggaataaatttatcaaacaatccatctcctatcctgtctgtgttattgtatcgctgacatgcaattcaccaattccagaccaccaccaccacattgcaacaccaagcaagcaacagtggcgtcagccaacctgcgaattagaaacacgttagctcatgaggagccctggatcgtgttgccacaatccaactgtgaaaaaaacaagataatggcgtacaggaacaagataaagacgcaacacagcagtttgcttcgaataaaacaggcacaaacaaaatcttgcgtctaacagaaatatcgctagtttcaggaaaatcagcatcaatccagccaaataattgataacccaacgccaggaaattctgaacttcca

SEQ ID NO: 332 - DNA, 1201 bp, Zea mays
  misc_feature (757)..(757): n is a, c, g, or t
  misc_feature (935)..(935): n is a, c, g, or t
  misc_feature (1013)..(1013): n is a, c, g, or t
  misc_feature (1055)..(1055): n is a, c, g, or t
  misc_feature (1174)..(1176): n is a, c, g, or t
  unsure (1)..(1201): unsure at all n locations
tgcatgcctgcagctagccaatgccttcgtatagaagcaaaaaatcacagaaaagtaagggccatgctgcccgctacttgttactatgattgctacctactactgtacatgttactatagcccactgctgtcatattgactaggaggaaggaagtagtcactgttcctatgagttatgacaaaagagagatgtgagagtagcagattattttacaatgacctaccacaaagatgcacgagtactccagtagtatagattctaatatagtgtatccacagttcaatgctgaaacaaagcttcacaaggttataaattcatcggcagaaacctcacttattacacaacaatataatcaggtagataagttgtactagtctgaagttaggccatggaatatttaaaaacgcttgccagcacaacattgccttgatttacataaatgtttaaagtatatacctgcatcaaaccccgctgataccagaattatatcaggatcaaaaactttagtgacaggaagcagtacatggtcccatgcagcaatataatcagcatcaccacacttgccatgctcccagggaacattgatgttataccctttaccagcttcttccccgatgaaacaatgagaagcatccccttcagcaggatagaagcttccataatcaaatctacaaaacaaacattagaacaataaacatttattatatctttagaacaatagatattttattatagcttcattaaggtgactacaantgatagagataaacagaggttttgtggcagattttctattccattaagccacaccacaaaccatggaaggattgggtacataaagaagaagcaaacttggaaactaagaaagcttcagcgtatgctatagtagatgctaatctaggattctaggtgctaagaaagataagaagataangtgctgacatatgcaccaactaatcctaagataagcacaaggcttagtctatcaacaaacacacactttctttttttnctcgaacacgcaggagagttgtgtatcattatatttaagagnaaaacaaaagtttaggccaaaagatggaccaaatacaacacctccttatggaggccagaagcaggcatacagaaaaagatccatcaagaaaaacagttaggcgacctctctcctaaacnnngaactatggccataatattctaaga

SEQ ID NO: 333 - DNA, 602 bp, Zea mays
  misc_feature (1)..(5): n is a, c, g, or t
  misc_feature (85)..(87): n is a, c, g, or t
  misc_feature (89)..(91): n is a, c, g, or t
  misc_feature (108)..(113): n is a, c, g, or t
  misc_feature (132)..(134): n is a, c, g, or t
  misc_feature (234)..(258): n is a, c, g, or t
  misc_feature (322)..(322): n is a, c, g, or t
  misc_feature (454)..(455): n is a, c, g, or t
  misc_feature (517)..(521): n is a, c, g, or t
  misc_feature (539)..(539): n is a, c, g, or t
  misc_feature (549)..(549): n is a, c, g, or t
  misc_feature (557)..(559): n is a, c, g, or t
  misc_feature (563)..(572): n is a, c, g, or t
  misc_feature (575)..(595): n is a, c, g, or t
  misc_feature (597)..(601): n is a, c, g, or t
  unsure (1)..(602): unsure at all n locations
nnnnnccacgccgaccctcgcggccgccgacgagctcttcgagggcggcaggatccggccgctgaacacgccgcacccgagcatnnncnnnccgctggccgacgacgnnnnnncctcgagctcctcctattnnnccggtggccctcggtggtccccgagaagagccggcggcgcggatcgtcgggcggaggcaccgttggagagaggcaggtcgggctacagacccgccgcctnnnnnnnnnnnnnnnnnnnnnnnnnctcgtcgaggagtaggagggccacgaggtctctgtccccgttcagggtcaggggcggcggcggnggaggaggaggcgtggacgacgacgaggagtcccctccgtctccccgaacctccatgatgcggggctgcggcagcggcagcaagaagtggcggctcaaggacctgttcctgttccgcagcgcgtcggagggnngcgccaccaccggcggcggcagcaaggacccgctgttcaagtacaccatgctgtcgtcgtcnnnnnagcagacgctgcggaccngcggcgacgncagcgcgnnnatgnnnnnnnnnngannnnnnnnnnnnnnnnnnnnngnnnnnc

SEQ ID NO: 334 - DNA, 1437 bp, Zea mays
  misc_feature (303)..(303): n is a, c, g, or t
  misc_feature (498)..(498): n is a, c, g, or t
  misc_feature (524)..(527): n is a, c, g, or t
  misc_feature (538)..(539): n is a, c, g, or t
  misc_feature (542)..(545): n is a, c, g, or t
  misc_feature (547)..(547): n is a, c, g, or t
  misc_feature (576)..(576): n is a, c, g, or t
  misc_feature (578)..(579): n is a, c, g, or t
  misc_feature (586)..(592): n is a, c, g, or t
  misc_feature (594)..(594): n is a, c, g, or t
  misc_feature (596)..(596): n is a, c, g, or t
  misc_feature (598)..(609): n is a, c, g, or t
  misc_feature (614)..(711): n is a, c, g, or t
  misc_feature (713)..(727): n is a, c, g, or t
  misc_feature (754)..(759): n is a, c, g, or t
  misc_feature (761)..(764): n is a, c, g, or t
  misc_feature (772)..(779): n is a, c, g, or t
  misc_feature (781)..(783): n is a, c, g, or t
  misc_feature (800)..(804): n is a, c, g, or t
  misc_feature (872)..(872): n is a, c, g, or t
  misc_feature (950)..(950): n is a, c, g, or t
  misc_feature (969)..(969): n is a, c, g, or t
  unsure (1)..(1437): unsure at all n locations
gttagcagcccaaaagcaactgccagcttctcactatgttcagccagtgcacgttccttagattgctcatcaatgtcttgcaacactaaacctgtcattggcttatacccagcttgccttaagcgatccatcatctctcccaacattttgtagatctccttggaccttggatgcgatctatcaccagaaataaactcgtgaattgtattctgccattcaatcgagcttcttccaggaattctctggattctctccctcctaagcgtcctcctcatctctgcaacaccttcccaggaattcgcntgtgcatatatgtttgacagtaagacatagtgcccatcggcatgaggatccaatactcgcagtttcgccatagcttcctctgcaacttctacattcttgtagatgcgacaagcccctagaagtgccctccagatgactgcatctggctcgaatggcatgtccctgataagctgctttgcctcctcaatatgaccngatcgccccaaaagatcaaccatgcnnnnatagtgctgannctnnnngnttacaccatgcactacactcattgagctnanntatttcnnnnnnncncncnnnnnnnnnnnntgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnntgatcatcgagctccaagtcagcacannnnnnannnncatagagnnnnnnnntnnnactgaattctcaatgtnnnnncacttggcatacatgtcgatcagagcggtcccaagcttgacatccaattcaaccccattgctctccanaaactgatgcacttcagcaccaacagcaagcgcccccatatcactgcacgccgagagcacgctcaccatggtggtgcngtccgggttgacacaggcngcgcgcatctcccgccacagctccagcgcatccttggacctccgccccttggtgtacgccgacatcatggagctccacgagaaggcatccctgtcgtccatgccgttgaacacctctctcgccaggtcgacctccccattcaccgcatacccatggatcatcgtgttccaagagaccatgtccctctcgcgcattccatcgaacactctcctcgcctccgcaacctcgccacgcgtaacgtatgccgcgagcatgacgttgcagaggaacacgtccctgcgcggcgcctcgtcgaaagcggcgcgcgcgaggtccgcgcgccccgccttggcgtaagcctcgacgagcgcggtgcgcacgaagaggtcggctgcggcgaagccggacttgagcgcgcgcgcgtggagggacgcagcgccgaggccgaggtcacgcatagccggaacggaggccgagagcgcggcggat

SEQ ID NO: 335 - DNA, 1309 bp, Zea mays
  misc_feature (1260)..(1288): n is a, c, g, or t
  unsure (1)..(1309): unsure at all n locations
gaggtcattcacgtgctggcaatgatgcagcaatttggtattgtgtaattgttgctggtcgtccaggtgcagaattaagcaagaagagacaaattttgcggaaggctcaagacaaattgttaggtgatgttgacagaagtgctgggaacgttgacaattcagtagagacatcaagtgctgcaactgccttcaaagatgataggttaacctttgtttggttagatggagaagtacaaaagcaaatttgtgccttctaccttgccactgattatactggagcctgtggccctcgagactttggagatgacaatgataaacctgaaatttttattgttcgattccaaagaaatgcaacatatgaggcactgaaagctgaaaaaaagaacaatcttgtggatgttctccagggacagcatgctgatgcgtcccagttagtggcaaggtacaagggcccagttgaaattgaagagataaataggtggatctctcagattatcaaagatggagatactagagaaattccttactttacttcaaaggtgccagatcttgtaccagaggaaacaagcaaagcatggaattctaaaagtatccgctcagcagggaaaagtctaaaagagaacatcggtttccatttccaagattacctaacccacccaatgattggttcaactttgcttatgtgcggatgtatttctatgggaatattatggttcaggaacaacacacccactcaaagtactcgacaggagaaagctcggaaagacaaggcaaagaggccccgtccgaagcttagcacgtcgctcttcggtgaaccttctgtcccagacgtcgacccaaaagatgctcgtcagtgggaaatgtcaagctcggattcagactaatgactcgcttcttacatttggacctgacgtactgcaaagacgttttaaaattaagtaaactacatagtagtgcggtggccttagttttgggaaatggaacagagtataaccgatatagtgaaaacagttggaccactgaagtaatccagttgccatctttccgatgcttcagctgccctgtgacgtgactccagggacgtatttgttgacacctgcttgaaaactgacaagcctctctattagacagagtgttaacctgtggtctcagaatggagtaaacaatggtagacagagtgttaacgtacatcatgtctgatgtaagccggcaggtattttcgtcgtgagccaaaactcggctaacgtcgtgacacggacnnnnnnnnnnnnnnnnnnnnnnnnnnnnncccttttcagacaaaaaaaaa

SEQ ID NO: 336 - DNA, 471 bp, Zea mays
cacgagagatgaggaagttcagtacaatgtcatggactcggcaacctccttctccacgcatttcatatcttgaacgcaaggttatgggctgaaccaaactcctgttcacaaactcgtagaagtagccctcggcaacctgctccaaagtaaagccttgtgtttcagcgataaacccttcagccatccatctccatactagagcatctttgtaaatcgtgtggtcctctggaaatgtactgagatacagcaaccaatttctcatgttgtgaggtagatccctgtaactcagagacagtatcttgtccatcacttccaggccactatctttcttgtgcatagaatggattgaatcaagtgccctctcccattcttcccttgttctctgtttagtagctaacatgctagctagagtaacaatagccagtggcaaaccatcgcatttctcgattatctcgtttttaatctcctcca

SEQ ID NO: 337 - DNA, 473 bp, Zea mays
  misc_feature (101)..(101): n is a, c, g, or t
  misc_feature (192)..(192): n is a, c, g, or t
  misc_feature (217)..(217): n is a, c, g, or t
  misc_feature (219)..(221): n is a, c, g, or t
  misc_feature (264)..(264): n is a, c, g, or t
  misc_feature (276)..(278): n is a, c, g, or t
  misc_feature (448)..(448): n is a, c, g, or t
  unsure (1)..(473): unsure at all n locations
tcacggggatcaacgtcgtcatgttctacgcccccgtgctgttcaagaccatcgggttcggcggcaccgcctcgctcatgtcggccgtcatcacgggcctngtcaacatgttctccaccttcgtctccatcgccaccgtcgaccgcctcggccgccgcaagctactccttgagggcggcatccaaatgatcnttgcacaggtacagtacagtccttnannnagggccagcattcttttcttgttgacgacgttggcaaacatgntgtacaatgcannncaatgcaatccatgcagttcgtgcttgggacgctgatcgcggtcaagttcgggacgacgggcgtggcggccatctcgcggccgtacgcgatcggggtggtgttctgcatctgcgtcttcgtgtcggcgttcgcctggtcctggggcccgctggggtggctggtgcccagngagatcttcccgctggagatccgct

SEQ ID NO: 338 - DNA, 695 bp, Zea mays
  misc_feature (3)..(13): n is a, c, g, or t
  misc_feature (26)..(29): n is a, c, g, or t
  misc_feature (164)..(164): n is a, c, g, or t
  misc_feature (187)..(187): n is a, c, g, or t
  misc_feature (272)..(272): n is a, c, g, or t
  misc_feature (322)..(322): n is a, c, g, or t
  misc_feature (574)..(576): n is a, c, g, or t
  misc_feature (617)..(619): n is a, c, g, or t
  misc_feature (627)..(632): n is a, c, g, or t
  misc_feature (634)..(639): n is a, c, g, or t
  misc_feature (641)..(643): n is a, c, g, or t
  misc_feature (646)..(647): n is a, c, g, or t
  misc_feature (649)..(649): n is a, c, g, or t
  misc_feature (652)..(693): n is a, c, g, or t
  unsure (1)..(695): unsure at all n locations
tcnnnnnnnnnnnccccgaagagagnnnnttctgcaaggatgtccaacatcttaaccatctgcaaggaatcatgaagtaaaccacctgaggcgcagatgctttaaaaaatagttttctttccaacatattgatgatagcacaataagaaaataggtatgtaatnttttaacttcgaaggaagtcacngacaagattctctaaaaacgaatctactcaatcacaaagagaactgcgcaaataaaaaagaaccaatgcagcgaaataagtagantacttttccacaacggccgagacaaatttcattaccatgaagaagaaaanttagattaaaatgtttaagttagagcttaacagagttactaagaaaaataagaaagtgtctgcctctgaacacgaaggcttcattcggcaaggcaaacattaaacaaattcattgttttggtttccaaacgcatgtcatttagaaataactttaagttcattcaagcacttttatttggtttccgattcttgacattttgaaacatgcccattcttttgttatcataccatgatgttgatatattctggaannnagctgcctctaacttaagtttctggttaaagactccgaatnnntcctgcgnnnnnngnnnnnnannnctnngnaannnnnnnnnnnnnnnnnnnnnnnnnnnnnnnnnnnnnnnnnntg

SEQ ID NO: 339 - DNA, 1053 bp, Zea mays
  misc_feature (32)..(32): n is a, c, g, or t
  misc_feature (76)..(76): n is a, c, g, or t
  misc_feature (85)..(85): n is a, c, g, or t
  misc_feature (136)..(136): n is a, c, g, or t
  misc_feature (290)..(299): n is a, c, g, or t
  misc_feature (304)..(304): n is a, c, g, or t
  misc_feature (362)..(362): n is a, c, g, or t
  misc_feature (372)..(378): n is a, c, g, or t
  misc_feature (410)..(410): n is a, c, g, or t
  misc_feature (428)..(428): n is a, c, g, or t
  misc_feature (460)..(460): n is a, c, g, or t
  misc_feature (468)..(468): n is a, c, g, or t
  misc_feature (486)..(486): n is a, c, g, or t
  misc_feature (497)..(497): n is a, c, g, or t
  misc_feature (925)..(925): n is a, c, g, or t
  unsure (1)..(1053): unsure at all n locations
gcattttgagtaactagcaccggaaggtggancggatgcttcaaatgaatcgccgccatacttgtatttccctgcngtcattacncaaaatcgtatatcaggtgctactgagagaagtcagcaaaacaccagctgntccgtgaggaacatacaagttaaaaaaaatgctatccaactggcaccataatgtcttatctgtccatgcactaatcacaagtctacaagcatagttgtgaccagcggcgctatagcaagcctatcaaggtaatataagatagacataggttttnnnnnnnnnncatanagaatgattgctgacaactaattaatttgtgggacgtcaagcaatgaccctttcccanacaaaaaaannnnnnngacttgaaaaggttcatctttttaatgaaaanaacatcaattcattgcanggagctacttcaagcttgtatacacagccaanaaacgaanatgaatcatgataagagngaccggggaanaaacaaccataccttgaaatccctctaacatacagttgctgtaaccattgccattgccagcttttaagacctccgctctagctgccagcaacccataatgcaaataactgcaaaaaaatgttttcagcaatactttatgatgtcatgagcagatataatcacacgatgtcatttccaacagactaccagaaaagtatacaaatgaccagtgcatgactctacgcaaaggaaatagtagtaaaatactattttttaatgacggtcacctaaggttactctacccatgagtagtgtcatctttctgcattttttcattacataacaattccctctaagtttctacttccagaactacaacaattttcagctttgttatgaaatatgactatgagtcaaaatacaagaaccaagggatttgcaatattggnaccaccatcaggtccttaaataggtttcacactgctgatgcttgttactatgccttgggttgccacaggtgatgtaaattaggactttaaaacagtagcaataattcaaagctcaataatttatagca

SEQ ID NO: 340 - DNA, 443 bp, Zea mays
  misc_feature (12)..(12): n is a, c, g, or t
  misc_feature (85)..(85): n is a, c, g, or t
  misc_feature (171)..(171): n is a, c, g, or t
  misc_feature (409)..(409): n is a, c, g, or t
  unsure (1)..(443): unsure at all n locations
gtccatcgccantgatcctgtaaatggcaattatgactctgctcctgtgatcgttagcttcttctcaaagcacaaggactccaangcgcctagtgtatatgaagataaagagctgcttgagaattttggttgcaagaagggtaggaaaaagcccgtcagaagcttgggccnagctccaaagccagaagccagtgatgataaggatcagttcatgactgtggatggccagaggggccgtaggaagtctgctgggagcttgtactcagctagaaaggccgaagattcatattggtgtgatattatcatcagcgatttcgacgacggagatagtgactatgaaggttgcaagaggaagcggccctctcagaacactaacaggagcgctaataagaagatgaagcaagagganccacctcaaggagccccatcagatatggaaaatg

SEQ ID NO: 341 - DNA, 751 bp, Zea mays
  misc_feature (3)..(3): n is a, c, g, or t
  misc_feature (5)..(8): n is a, c, g, or t
  misc_feature (17)..(17): n is a, c, g, or t
  misc_feature (277)..(277): n is a, c, g, or t
  misc_feature (566)..(567): n is a, c, g, or t
  misc_feature (588)..(594): n is a, c, g, or t
  misc_feature (598)..(599): n is a, c, g, or t
  misc_feature (611)..(613): n is a, c, g, or t
  misc_feature (616)..(617): n is a, c, g, or t
  misc_feature (619)..(622): n is a, c, g, or t
  misc_feature (632)..(632): n is a, c, g, or t
  misc_feature (647)..(654): n is a, c, g, or t
  misc_feature (657)..(666): n is a, c, g, or t
  misc_feature (682)..(682): n is a, c, g, or t
  misc_feature (684)..(684): n is a, c, g, or t
  misc_feature (686)..(715): n is a, c, g, or t
  misc_feature (717)..(750): n is a, c, g, or t
  unsure (1)..(751): unsure at all n locations
ccncnnnnctaagctgnagtctcactatcctatatactaaagtgacatggctgcaagcgaatgccatccagttctgccattagcaaaataagttatgcgtaaaaactttgcttcatatgtacatttttctatgttttgttgattgttatcactattcaaagggttgaagtgtacacacctagtaaatggttagccctacatgaatattgtcctgcgatttacttattgtggcttccttcttatagagccatgtatgaaacttgttaccttgcaaatngaacctgttgcaaagtgtcttaagtttagaggtgtgatgtaatgttattaccaatctgcacaaaatgttaccccaattcagaaattggctctatcatccttttgtttatcatcgtgcttaactgtgttgctttttgcccataagaagacaagttattgttgctattgttcttctgtaccacaccaatagcataatccaatgttttgaagatgttgtgccttttgaagtacaacaaatcatgtaaatgtttgggctttggagtctttcatgatttgtttgtttcttgcannctgcatgtgatgaaacttctnnnnnnncagnncaagcatttctnnnacnncnnnnaagttcgacnaatggggacaacatnnnnnnnntgnnnnnnnnnnactacatatgatgatnantnnnnnnnnnnnnnnnnnnnnnnnnnnnnnngnnnnnnnnnnnnnnnnnnnnnnnnnnnnnnnnnna

SEQ ID NO: 342 - DNA, 719 bp, Zea mays
  misc_feature (46)..(47): n is a, c, g, or t
  misc_feature (70)..(70): n is a, c, g, or t
  misc_feature (216)..(216): n is a, c, g, or t
  misc_feature (273)..(273): n is a, c, g, or t
  misc_feature (630)..(630): n is a, c, g, or t
  unsure (1)..(719): unsure at all n locations
gtttcacattattaagtctgattttcatatctcctgaccacaaaanntttcaaccgcattaccctttacnttttattgcctttcagcaagaaagttaatattaaccttcaggacacaatgctaatactgaaccaatatttcatacaggattctgctgataaaatggcagtgacaacaattatagttcctaatgcactgaataatatgacagctacntatagactaaatgtgaaacataacactaaagctgagtagcaaattacctggaccagnagcacgttttttagatggtgtagcaggcaagccctcgatacgaacattctgccttgacactaagtcatcaagagatggcattggttcagccaaaagaccaaggcggtttatttctgaagcaacagatggcctggcaacaatcagtgagttatacaatgatgaacctttctcccatgccatgctttccaaaagctgttcttctaaggaatttaggtgccttttcaattctcttgggagggtctcttcatgtctcacaaagttctcaattattttgctcaaatcaaatgcagttagaccggtactctcaagaacagcaggaaacatcatgatgactgtcttatgtgtcgccaatactangtccgctgaacatgcaatcaaacatcggtggaaacgctcatttgacagcaatggagttagattatttacattgctgttttgtaactccg

SEQ ID NO: 343 - DNA, 1813 bp, Zea mays
  misc_feature (136)..(136): n is a, c, g, or t
  misc_feature (408)..(408): n is a, c, g, or t
  misc_feature (486)..(493): n is a, c, g, or t
  misc_feature (603)..(603): n is a, c, g, or t
  misc_feature (804)..(804): n is a, c, g, or t
  misc_feature (820)..(820): n is a, c, g, or t
  misc_feature (1114)..(1114): n is a, c, g, or t
  misc_feature (1392)..(1396): n is a, c, g, or t
  unsure (1)..(1813): unsure at all n locations
ggggctaaatgcagctgcaggatccgaggtagaaccaccatttatctggcccagactgccggctaccactgagtcactcaccatgtcgaaatttaatcgactgtttactttcctgccattactgcaaatttaacangaaatggagtgatataaattagtgttgtagacatgaaatcatgttggacaaaagaaattgtcattttgagattcatactaatttaggcggctatttatagcagccaaatccttagatgggctctgataagcatgggtgccttcaccaatgcatgcataaaaactcctggaacttggtgacagcagtagatccaactgacaagtggcatagaggaatgtgttattggaaaagggaacacggtaaatagttaagtgctatgattcggcagcatnactattatgatatgaagtgaacaataaggtggaagtaccattgactagtcttcaaataatttacaataaaatgaaatnnnnnnnngtggtgataacaagctgtagtatcgaaaggtatgtcaaacctaaggaacttagaaaatgtacatctcaattctcaagaattattcccagcttttaatgaaatgtaaggantaaggagtggcctagaaaaattctaggtattcatcgacacaatacactactgtgttatggctcttgtgagacttaacctctagcctaccccgcgcttgggactcaatggctttgtcattcatgctgttgttgacacattactgtgttgtaaaattttaaacatgcatatgccatattaatcagaaaattattgataaccanactactttaccaaaancagattggagacaaatgagttatcttacttaagagcaaatataaagaaagtaaagcgaataatgagaagaaaaaccttggtttgccgcaaaggagacacatatacattatgagatgctgaaactttcttcggggacatatctggtaaatttgggaaaggagatggcttgggtgatccaagaatttggcctaagcaacagcaatgacatcattgacttgtaggaaaagaaaaggcaattcaaactgagaaagtgggtataacatataccactagcattcttcttgtcttctggangagtaccagatgatattaatgacaccaggaaaggcttggctgctggaacaaatacctcattgtaaaaagtaatgatatcaacatggcgtgatattaatacctgttgataagaaataactttcagaaaaagaagcaataaggagcacccaaacaatgaagaactgtcagaatggaagtgcaaatatagaagcatagatacataccccattatgattcctacttccaatatagatgcttaaaaaaacttctggttggcattgtgcttcttttttgtaatnnnnnagtatctccctgaatgagagttctaattggcaaacctgtcagagaaggcatgatcaaccagcctagataaagggaagtaatgacaggatgctcattaaatagtgtaaacgatacctttgcaacaccataaagacagcaaagaataagttgatcgatgtgtctattaaaaaataatgttgtctgttgatcaagaatctgcttgaagacattatagacacgctctgtctgttccatatattgaatcctttcacacaagtttcttattctaatagcagctaacttcagaatctgaagaaattacaggtcaaaattaaaactttaggaaagaagataaatcataaagatgaagttctgattatgagaaaatccatactttggaaaagaatatatgaattgtcacgtcagcacatttttcgt

SEQ ID NO: 344 - DNA, 510 bp, Zea mays
  misc_feature (9)..(9): n is a, c, g, or t
  misc_feature (187)..(190): n is a, c, g, or t
  misc_feature (376)..(377): n is a, c, g, or t
  misc_feature (380)..(385): n is a, c, g, or t
  misc_feature (397)..(397): n is a, c, g, or t
  misc_feature (399)..(401): n is a, c, g, or t
  misc_feature (404)..(408): n is a, c, g, or t
  misc_feature (421)..(423): n is a, c, g, or t
  misc_feature (431)..(436): n is a, c, g, or t
  misc_feature (444)..(445): n is a, c, g, or t
  misc_feature (448)..(450): n is a, c, g, or t
  misc_feature (455)..(465): n is a, c, g, or t
  misc_feature (474)..(475): n is a, c, g, or t
  misc_feature (477)..(495): n is a, c, g, or t
  misc_feature (500)..(509): n is a, c, g, or t
  unsure (1)..(510): unsure at all n locations
cattgcagngcatcaagtgactggaggggaaaaatcactagctttttagatagccatacaacatcaaaagttatggggataaaaaattaaaaataaagtacaacactaatgctttgcttttattttactggatagaaaatatccataaataaataaacaaagacaaatgaaaccaagaaaaagttgnnnnttttatcgttgattctgaacagagacatctaaagtactggaacccattgttagcaaattctacaaatactactgaagtaatacttgttggctgaccgcttacttccaggttccatagttgcggacagtaacatctaagcaattattttaactaagctttaagaagtgatgttgatgtagcataccnnttnnnnnncacggaagcctncnnnttnnnnnctcacagacaccnnngtaagttnnnnnnctctacannacnnnaaacnnnnnnnnnnnttaaaacanntnnnnnnnnnnnnnnnnnnnacacnnnnnnnnnna

SEQ ID NO: 345 - DNA, 649 bp, Zea mays
gccaatgaaagatcaccccttagcagtaagaacattctgttgcaaactaatgcttatattagccatcagtttatcagccttttactactttgcatgtagttggagtgttcgaaatctgatgctcaagggcagcttggcagaactttggaggatgcacagaacataactgaattatcaaatcaggagaacctgttacccacggtgtctcctggctttatatcaacgtctaatgggaaaggtatgaacttcagaaactctacccatggtcaaaatgggcatagtttgctacataactgaggcatacatgaaagtagaagattgatgattggatttctgtgtgcaggtactaacatacatgatactcaatttgaggaagagccgacaggtatgaacaacagccttattgaacctaatggaaatgatgacatgtgcacagaccatgctgctaccaaattagctaaaagcaaccatgttatggaaacagctaccctacctattgatgggagttcacagtgcatcattgacatttctccattgaggagctgctctgctttggagagatctttgccttcaccaccgcaggcttcgttcgtcaagaggtcacctgtgtggcatgtagttgacgcaaaacatgtgtttaaggagttac

SEQ ID NO: 346 - DNA, 406 bp, Zea mays
tcaaggtcaaccgtactcaacagacatttcatggttagctggcctatctttgttggagtatcttgacatgagtgaggtaaacctcagcacagttgctgattgggctcatgtggtcaacatgattccttccctgaaggtcctccatcttagttcttgttcacttctaagtgcaaaccaaacactcccacgtattaaccttacagaccttgaaacacttgatctgtctggtaatatttttgaccacccaatgtcatccagctggctttggaatttgacaagcctccaatatctcaatcttgaggctaatcatttttacggtcaagttcctgatgcgctaggggatatggcatctctccaagtcctcgatttgtctggtaatcggcacatgggtactatgacaacaagc

SEQ ID NO: 347 - DNA, 739 bp, Zea mays
  misc_feature (454)..(455): n is a, c, g, or t
  misc_feature (565)..(565): n is a, c, g, or t
  misc_feature (590)..(592): n is a, c, g, or t
  misc_feature (629)..(631): n is a, c, g, or t
  misc_feature (642)..(642): n is a, c, g, or t
  misc_feature (658)..(658): n is a, c, g, or t
  misc_feature (662)..(662): n is a, c, g, or t
  misc_feature (664)..(664): n is a, c, g, or t
  misc_feature (676)..(679): n is a, c, g, or t
  misc_feature (683)..(684): n is a, c, g, or t
  misc_feature (686)..(696): n is a, c, g, or t
  misc_feature (700)..(708): n is a, c, g, or t
  misc_feature (711)..(717): n is a, c, g, or t
  misc_feature (719)..(720): n is a, c, g, or t
  misc_feature (722)..(729): n is a, c, g, or t
  misc_feature (731)..(737): n is a, c, g, or t
  unsure (1)..(739): unsure at all n locations
ctataaaacttaagagccataataaacaatcacttaaaagtttggacatcattcaactattgaaagttacaacaggaaaaaacattcacgaaatttgtcagttctgacacaacaaaagtacacaaaccaatggctaatttcttcaatcctcaatcctcataatttagaatagaacaatattttatcttcgggatctcaaggaagcatgttaagttgttaactaacaaattggttgctagcaattagagttagcagctagctttaacggatagcaagcaactaaaagttgctagctagctattaattctgatcactgtactgggtacccatttcaaaccaattatatcagaaaaggagcatgatatgtcagaaatttagatctggttcctaattgaacaaaattccatgaaaaaaaatcattgcataaatattgctctggcgtagtgatatatanngcataagtagaagtgaccatcaaggaccttatcatatgaataattgaatactgctgaatattgaggtggtattttgaatatagtagatctctgctgctaagaaactagtnaaaaagagttggattgagttctgtnnnttcaaaaaaatgtaagacaatttgtaccaccaccctnnnatgtaccagtnccacacctgaacatgnctcntnggctgatgttcnnnntatnnannnnnnnnnnncatnnnnnnnnnttnnnnnnncnnannnnnnnntnnnnnnntc

SEQ ID NO: 348 - DNA, 647 bp, Zea mays
  misc_feature (179)..(179): n is a, c, g, or t
  misc_feature (324)..(325): n is a, c, g, or t
  misc_feature (573)..(573): n is a, c, g, or t
  misc_feature (601)..(608): n is a, c, g, or t
  misc_feature (619)..(622): n is a, c, g, or t
  misc_feature (625)..(631): n is a, c, g, or t
  misc_feature (635)..(636): n is a, c, g, or t
  misc_feature (638)..(640): n is a, c, g, or t
  unsure (1)..(647): unsure at all n locations
aataggccggttaactgtgtaactgatgaatcatcagggaaggcaggccaggggaaccatacctgttatcagataagcaccatcgacggagaagacacagtcccaaacccaacgctgatggcctgagaagttgattgccaatgatgtttcagggtctctttcgaagatataagatgganctgagatggagagttggattaaagaagactccaaacattaccgactaaagttctttccaacttgaagccatcgacattccaaatctttacagtgcggtcagatgatgctgtggcaagatacctgcaaacaaaacccaagaatgtnnctcatagaatccaagagaacacaatagtacgctggaataaccgtgggaaaatagccttttagaccatcacactacctgtttggatcgcaaaattcgggtgaaagcaggcacttcagaatgtagccatcatgggcttgcagtttgtgcagaggttcgaagcaggtaattgtctacaaaacagaatttgacaacttgaaaaaaaattcagaaatcgcaattctacatttaagaacaggtaggtctgaagnacaaactgacctgagtacccttaagcannnnnnnnacgtaacatgnnnnacnnnnnnntgcnncnnncaccata

SEQ ID NO: 349 - DNA, 435 bp, Zea mays
  misc_feature (92)..(92): n is a, c, g, or t
  misc_feature (110)..(110): n is a, c, g, or t
  misc_feature (117)..(117): n is a, c, g, or t
  misc_feature (150)..(157): n is a, c, g, or t
  misc_feature (240)..(240): n is a, c, g, or t
  misc_feature (328)..(328): n is a, c, g, or t
  misc_feature (395)..(395): n is a, c, g, or t
  unsure (1)..(435): unsure at all n locations
tttctctgttcttccttgttcagaaaaactgaatgaactgcatacaaccaaaatgattcaatcaagaagtatcctgagcgcttatcgcgacntgcgtttgtgcatcttcnccacgcnggcacgatgcgtccatgtccgcatacttctgcnnnnnnnngtccacaagaatcggagctcgcgcgcatgcaggaaatgaacacaatgcacgaacagctaaccgaactaactgaatcgcgtgcncaaagcttaacaaatcgaacacaaaataggtttagcagacgtatggttttagagttcaagagctcaatgtagacatcaacaaaagttngtctttaattcagcgtgatttacatgacatacaaaatttactgtgctacacgtgttttaatagatgngtgcatgcttgcaggttatcctggcagacaccattgaagc

SEQ ID NO: 350 - DNA, 350 bp, Zea mays
gtcgcaggtgccctgcatcatttgggcattggaatcactcttacgaatccactgccgcccttatttgctacatagacagatatgaaaaacagtagggaaggagttaaaatgtacagtataaattatatgctattactgggagtttctagggccttctaatccatgttagtaattccgaattcatgctagtaattcttcgggaatatctgttgcctaatataacataaccctgaattaatgctagtaattattttctaggtagttaaaactctcattttatgtagggtaacactaggaaatttctcggttctaatagataattttcgaatattatagatacatattgctgg

SEQ ID NO: 351 - DNA, 1210 bp, Zea mays
  misc_feature (6)..(10): n is a, c, g, or t
  unsure (1)..(1210): unsure at all n locations
tgcctnnnnnaccttactcaaacagtatggaaaagtattaggcctagatcctaaaaggattccacagaattgggcagccactcaatttgctgaagcattgggcagagcatgggccgagtataacaatgacaggtcagcgcttttctatgcagcatgagttgtattattcagaatttctagaaaatgtaagtgtcaattaacatgttttgttctcttttgtcgctcagtgctgttgttttgatggttgtccaacctgaagaaagaaatatgtacgaccagtactgtcttgtcaatcatctgaaggaatcatatccttttttatgtttgctttcttttcagttttcactcctattgtcagattttcaatatctgggttgtgaaaaacttcatttagttattgactaattcctatcgtgatagtgtttccttatctgtggtttggcggctcgtctccacaacaaactaataagatgttgatttcttgtatgtacactgctgtattattctttcaacatattgcctgcctgatataacttcagagaaccattaaagtgtgcggcaagcatctgctttttttttgggtctggtattaagagcatccaacagcatgaaaaatgtggctttccttaactagccatcacatatggtgtggcaactataaggaaaacattggcacaagtagaggctcaagggcaggttcttacagatggaacacttgtggtgtaagtatcttatatagacatggaaaaaggcttattattactatcagaatttagtatgtaaatttatgaattgcagagatggtcggacagtggctgttgtgtatttcagagccgggtatgcaccaactgattacccttcggaagcggtatgcaatcaaatatctattaattcaaaatctttatatagaatagaagtaaattctgttttttgagtgaaagaaactgttcctgtaattgttttaaaaaaatcatatgtctggtgcaatgccgcttagtctcattttcctgaaacagtcatcttcttttgtgcatgcatttctgtctctgttggaaagcaatccttagccaaatggttttattgctttggttgaggatgtgtagtaattcattttgttatgattatgatatggcaccactgttccaccttgacataacgctatcatattccaggagtggagagcgaggcttctgatggaacaatcatctgc

SEQ ID NO: 352 - DNA, 722 bp, Zea mays
  misc_feature (424)..(424): n is a, c, g, or t
  misc_feature (492)..(492): n is a, c, g, or t
  misc_feature (670)..(676): n is a, c, g, or t
  misc_feature (679)..(679): n is a, c, g, or t
  misc_feature (683)..(691): n is a, c, g, or t
  misc_feature (700)..(703): n is a, c, g, or t
  misc_feature (706)..(706): n is a, c, g, or t
  misc_feature (708)..(714): n is a, c, g, or t
  misc_feature (718)..(719): n is a, c, g, or t
  unsure (1)..(722): unsure at all n locations
ctagacagcaagggtctagccatactgtccctgagtcatgcactattgcacctgaaagaaggtcatctggagcaggaacttgtgctccaatttcttatcccaccagcagcggggaaaaactttcagatataagtagctcctcaccaagaagcatgacaaaggtctggtagtcatttgtacgctcctttcaactgtgccctttgggcttcatctacttctctttgtctctcataccgtcttctatttgccttacgctgccaaattaacttttgaacatgaaagcaggcaactttagtgacaaactatactgtttgtggatttgcagagtccatcagtcacatgcaggaagcctctccaatctgacaatacttctcacagtcaagaagaggactcatattctgtcacttcttcgtatccttttttncttttcaaatattgatcatattaattttccagtggatcttattgttctgtctgtttagtgtctccttnttctttaatattttatgcatatgaactccataacattttgcatggaacccttttctattcctaaataactgtctgctagtaaaaagatcgcttcatttgtatcccccaattttcattgtatccctcaatttcctgagctgtgtacagaactgtaacttcagcgagagctggaaaaacnnnnnnnacnactnnnnnnnnngcacctacnnnngtntnnnnnnntcgnnctg

SEQ ID NO: 353 - DNA, 548 bp, Zea mays
  misc_feature (32)..(62): n is a, c, g, or t
  misc_feature (76)..(77): n is a, c, g, or t
  misc_feature (414)..(414): n is a, c, g, or t
  misc_feature (522)..(522): n is a, c, g, or t
  unsure (1)..(548): unsure at all n locations
gttcctgattgattaactggtatgttcacagnnnnnnnnnnnnnnnnnnnnnnnnnnnnnnntcatgcatgacctnnggtcaaattttttcgacagcaatcagaatcgctttgccaatatgcccacaacaggttacaacagctcactcaggtcacattacatagtatcagcgaatgctgcccccacgcaatgacaatatgcccggccgtttggttctcacacaggaccgactcggtcaccccatacaaaacttgcagcaaatttacagacacggacacagcgcacggtctctggcagtggcagccaggttcttacaagggcaacgccaaaaaaaaaacaatccagcaccaggcacactgtctgctgccggggcatgaggccatatttccgggtgatgtgagggtatatgaattnagatgaaaaacggcatggcaatggatgcttcacgggtcaggtttgtacagcggcggcgcttggctgctgtcccgctttcttctcacggaagccctcgggtcttccctnaatttgggggcgccctggacttagca

SEQ ID NO: 354 - DNA, 367 bp, Zea mays
  misc_feature (26)..(26): n is a, c, g, or t
  misc_feature (250)..(250): n is a, c, g, or t
  misc_feature (332)..(332): n is a, c, g, or t
  misc_feature (362)..(362): n is a, c, g, or t
  unsure (1)..(367): unsure at all n locations
cgcaaccacatgagaaattgtgaagncgaccataaatcaaagttcactggaaaacaccagcacaatgacatgtacaaacataaccacaggtgaaaaatatggtggttcacaggtgcaatactcacctcttcatcaggacgattaccagttacagtaaaaacccttctttcaacaacctcccgatactcttgcctgattgcttctctcaaggtctgcaccagataatataataggataacttacatgatanaaacaatatatttaattttctccacagatttgttggcaatcggcaggtattccattatttacataacttgaagcccttctanaatcatactatcagctaactactactgagnttcga

SEQ ID NO: 355 - DNA, 668 bp, Zea mays
  misc_feature (659)..(666): n is a, c, g, or t
  unsure (1)..(668): unsure at all n locations
gcaggcacaactggaacaatgaaagaagaaaccataaatagctgatgaagtcaaatgcaatatcacaaaacaaaagcagcaaagaaaacaattaaaggagtccaagtttatggtgcataaaggctcaaaatcgttttgtcagaacaagcagaaacaactctaacctactgcaaaatgcacccccacgctcagagttctcatgccaatgtggttttgcatatgaaaacaaacacaactacggtcaatcctgcaattgctgtatggcaattaaaaaagcttccatcaacataaagacatcaaatgtgtgagtacacacactctatccagctttaacccagcttaacacctcgggaatagtacaataataatctagtaacacctacatacacaatatctaagatatcaatgaatgcataacaaaatggacagactacataagacattgtaaatccatacagaatagcaataccaaatcgtagaacaaggaaataaacaatcatgatgtttattgtacagtgacaactctggccacatcacttacaaggacgccatttgcagaaaagattaaaaaataatcagtgtacagggtagcagaaacaccacacatgaacagcaatcagataaaaagtcgtagcaaataggagacagcaaaatgcagnnnnnnnngg

SEQ ID NO: 356 - DNA, 485 bp, Zea mays
  misc_feature (100)..(100): n is a, c, g, or t
  misc_feature (160)..(160): n is a, c, g, or t
  misc_feature (369)..(370): n is a, c, g, or t
  misc_feature (456)..(458): n is a, c, g, or t
  unsure (1)..(485): unsure at all n locations
cacctgggttggatactggagaaggttgcctgaagagactactgaagctaagctactgatgcgttatttggttcagttaatcagttgtatcctctgcccntgtaggctgttgtacctcacctgtgtcagcaacatttttgtgaatctaaaacagttagcncatcaacaatgctgacagactagaaccgggctttgccggtctggatgtactgcttacatgcattgatgctagtgtggacagcaaatctctgcactgcatcatcagactgtgttcttgaatgaaaactctggagagctgggacgcaaagacatctgtccgagccaactgcagaagatggaagacggttcagactggaaaatagcagcatnntcatcttagagattttgtgatattggcagcatgcatccagtctgtgtaaatgtcatgtgattcaaagagaactaactggaaaaagnnnttctgtatgacggcagcaccttaggca

SEQ ID NO: 357 - DNA, 432 bp, Zea mays
  misc_feature (290)..(290): n is a, c, g, or t
  misc_feature (431)..(431): n is a, c, g, or t
  unsure (1)..(432): unsure at all n locations
ttccttgtgactgacatcttttcttcacacgatctcactgcacaaagatacaatgtatgtactaattatgcttgaaagaatttctggtactcaaatctcgatgacagaaacaaacgcaatgtattaaaatctctgaaggcatactttctaaccaaagggaaaaacaattacctgcactgtgggcagcttgctatcggtaattaatatccatatcccggttggcatgtctgagcgtaagcgtagggatactgaggagaccaaacgaagcagtcgcgtccgaacccgccgcngctgttcctttgagcctgccaatatttatgcatgtaaacaacacacagcttggatggaaagtagcaaataaacaagcgacgggaattacctgcttgtcagcagaagggtaaccccacgaaagttttatggctttacctccna

SEQ ID NO: 358 - DNA, 740 bp, Zea mays
  misc_feature (243)..(243): n is a, c, g, or t
  misc_feature (247)..(247): n is a, c, g, or t
  misc_feature (593)..(593): n is a, c, g, or t
  misc_feature (604)..(606): n is a, c, g, or t
  misc_feature (633)..(635): n is a, c, g, or t
  misc_feature (639)..(640): n is a, c, g, or t
  misc_feature (665)..(670): n is a, c, g, or t
  misc_feature (674)..(677): n is a, c, g, or t
  misc_feature (679)..(722): n is a, c, g, or t
  misc_feature (726)..(736): n is a, c, g, or t
  unsure (1)..(740): unsure at all n locations
tcaattgggaagaagattcaatacaattgtcatggcttcttaccaaatcaacgtcaggtatccctcttgaagctttacattttccaattgcttcgctgccatcaaaattatccaccatgtaattgttcgactgtccagactgatgagtgcttcagcttcaccatgacctcagttctttatatgtttgaattaatattgattacaattaagaatgaaatagatctgcacctagaattttctacnggtngaatgtgacattatttgagaggttgattacattgattatggtaaagcatcaatcaatatatacatttgagggagtatattgtgatgcttaccttgctttgttttagttgatatgcaaggaatactgtattgagttctctactgtcactgggtgaacacatagaagtcttgttgaggatattactgaaggataaatcaagcttgctgggggaatatacatatgtagctttttttgtgcctcacttatctggataagttttgatgaatgctcttttacatagttgcctctctagacatgctagcagagattgagcactaacccagttctgaactgcatgatgttggcnaatgatggccnnnctactactcatttacgcttgctttctnnnactnngcttgtataattagagtttatatannnnnntgcnnnncnnnnnnnnnnnnnnnnnnnnnnnnnnnnnnnnnnnnnnnnnnnnttannnnnnnnnnnatta

SEQ ID NO: 359 - DNA, 532 bp, Zea mays
  misc_feature (10)..(10): n is a, c, g, or t
  misc_feature (19)..(19): n is a, c, g, or t
  misc_feature (209)..(209): n is a, c, g, or t
  misc_feature (215)..(215): n is a, c, g, or t
  misc_feature (232)..(237): n is a, c, g, or t
  unsure (1)..(532): unsure at all n locations
atttataacnaggaatctnttcttctgtttgctctatagccaatgcttgtgttactgctctaaatggtttgctgctgtaagattgggtactaacaacaagatccattttttggatgtgcagagccaccttatggccgagtctatttctgagctacagaagaaggtaactaaagctgaaaaaactttcaaggcagttgcactcaggcttncaaaanaaaacagcacttgagtnnnnnnggccatttacctgctgatgatttgtggttcagaatgctctgcatctgaacagccatcaacagtagattgatcattgcagaaatgactgttggtactgctgtggtgtgcaggagaggtcactgcaggaggagaacaaggctctgcagaaggaagtaagctgccagagactgactgcaccctaaaccattgcattggcaacagaagggtttgatgtgtgtctcctctttttgtgtagcttgcggagaggcagaaggccgtcgcgagccggcagcagcaggtgcagtgggaccagcag

SEQ ID NO: 360 - DNA, 359 bp, Zea mays
  misc_feature (23)..(23): n is a, c, g, or t
  misc_feature (69)..(116): n is a, c, g, or t
  misc_feature (351)..(351): n is a, c, g, or t
  unsure (1)..(359): unsure at all n locations
acaagccattctcggcgcagaanttagttaacaagctagacgaacccgccgctacctgcggagaacctnnnnnnnnnnnnnnnnnnnnnnnnnnnnnnnnnnnnnnnnnnnnnnnnagagaggaggagcgggttgagccggcggaggcaggcggacgaggagcatgagaggagagcggaggacgggcgcgcgagcgccattggcggttggcgcggcctcgcttgagataaaccctagtgggcgcgcaggagggctcggatgccgctatcgctgagagggagcctgtgagggaggggtttggattcgggataacgccggacggcggcaccgcgggagtgtggtgctgagcancctgagca

SEQ ID NO: 361 - DNA, 715 bp, Zea mays
  misc_feature (97)..(97): n is a, c, g, or t
  misc_feature (201)..(208): n is a, c, g, or t
  misc_feature (215)..(215): n is a, c, g, or t
  misc_feature (277)..(277): n is a, c, g, or t
  misc_feature (313)..(318): n is a, c, g, or t
  misc_feature (347)..(347): n is a, c, g, or t
  misc_feature (356)..(356): n is a, c, g, or t
  misc_feature (401)..(401): n is a, c, g, or t
  misc_feature (480)..(480): n is a, c, g, or t
  misc_feature (483)..(483): n is a, c, g, or t
  misc_feature (488)..(488): n is a, c, g, or t
  misc_feature (576)..(578): n is a, c, g, or t
  misc_feature (584)..(585): n is a, c, g, or t
  misc_feature (601)..(606): n is a, c, g, or t
  misc_feature (611)..(612): n is a, c, g, or t
  misc_feature (644)..(644): n is a, c, g, or t
  misc_feature (650)..(651): n is a, c, g, or t
  misc_feature (656)..(656): n is a, c, g, or t
  misc_feature (665)..(665): n is a, c, g, or t
  misc_feature (680)..(680): n is a, c, g, or t
  misc_feature (685)..(690): n is a, c, g, or t
  misc_feature (694)..(694): n is a, c, g, or t
  misc_feature (696)..(699): n is a, c, g, or t
  misc_feature (701)..(704): n is a, c, g, or t
  misc_feature (708)..(711): n is a, c, g, or t
  misc_feature (713)..(713): n is a, c, g, or t
  unsure (1)..(715): unsure at all n locations
ttcttgagagccatcctcctgcgtctggatcctcacacaaaatgcacctgcacaacaagagacgccaccggttgtaactaccaacaagaaaggctcntcttctcttttgttgacgagcccacaaaggtccagatcgcaggcgcaaacaagagatgcacaaacaaatagaagcacctgataatctaatttcctggataaggnnnnnnnnaagaacnggtgatcaagaaccgaaccaagaaattaaaaataaaaacgaaaagaaaagaaaaaggattantgggatgaaatcgttcgtcttggttggagttggagnnnnnnaatcccaacgcggcaagtatctccctttnctttcaagnaagtagcgtgctgttttccaagaacgggtggcggtgaggcccccnagttggcagcggccgatcttggagcccaatcagtgcggtgcgtgcgtgacgccaggtcggtcggtctctctctatatanatntcggnccagtgctccagtgaccagtggaggcgagacaccgcagggccaagtttttcaattcaagatgagacaaaaagaaagaaaaagaagtannnataatnnagagagcgagaccccnnnnnncgganngataagctcgagccgtcagcgtcgagcagcangagcannagcangagcactgnagcagcagcgcatcnctatnnnnnncccncnnnnannnnccannnngnaa

SEQ ID NO: 362 - DNA, 563 bp, Zea mays
  misc_feature (246)..(246): n is a, c, g, or t
  unsure (1)..(563): unsure at all n locations
cctggtgcccgagagtactccctgaggcgattgcttttagatgttcctgacaatgttgacatggttatcttccccaattatgtgagttgcagaagtaacatgtttgttgaatatggtaatgtgtttcacatctgattactgtattttttttcaggagagcagcattgaacgtgatgacattaaggatcctttcactgaggtataagagctactgttatctgtaacatatatgcaaaataaaggggnaaatggctctgtgtcctattgatgatccaccgactcacttgggaaacaaaactggatagtctcactgtttagaaaaaaacactatagtttagcaaacactgcacagaactactcattattgcattgcagaaaatgataggactggtcggattatcgttggctgtatttgataggttgcatcatttataaattcttttgtgcctgcaggtttccatgtttaagaaaaattatgaccatcttccaaaggatacatactttggcctgtacaaagaagcaacacgtggtaatccaaactacttccttacttatggtaatgg

SEQ ID NO: 363 - DNA, 452 bp, Zea mays
  misc_feature (16)..(18): n is a, c, g, or t
  misc_feature (21)..(24): n is a, c, g, or t
  misc_feature (106)..(107): n is a, c, g, or t
  misc_feature (109)..(109): n is a, c, g, or t
  misc_feature (315)..(315): n is a, c, g, or t
  misc_feature (317)..(319): n is a, c, g, or t
  misc_feature (336)..(340): n is a, c, g, or t
  misc_feature (347)..(353): n is a, c, g, or t
  misc_feature (358)..(361): n is a, c, g, or t
  misc_feature (364)..(364): n is a, c, g, or t
  misc_feature (369)..(371): n is a, c, g, or t
  misc_feature (382)..(382): n is a, c, g, or t
  misc_feature (390)..(390): n is a, c, g, or t
  misc_feature (396)..(396): n is a, c, g, or t
  misc_feature (416)..(417): n is a, c, g, or t
  misc_feature (423)..(429): n is a, c, g, or t
  misc_feature (438)..(443): n is a, c, g, or t
  unsure (1)..(452): unsure at all n locations
tgtaagtcatacatannnaannnngcggactaaaaatgctggtgttactccctccatcccggaatgatatattcatgtaaaagtcaaactttacgaattttggccnncnattattcaaattatataaaattttaaggcataaaaaaggctttgatggattcatatttgaattgcctctgatctgatatcggaactctttagcaaacgaaaacatacagtaagaggaattaatggtcaaaatctaatttgtttgacttttcctgatatgattaattgattatcattccaagacagagggagaatattactccctcngnnncaaattaaaattcgttnnnnntatttannnnnnncatannnngantaatnnntatgtttggtntatatgtntagatncatcatctatttgaatatanncataannnnnnngtgctaaannnnnnactaatatg

SEQ ID NO: 364 - DNA, 696 bp, Zea mays
  misc_feature (44)..(44): n is a, c, g, or t
  misc_feature (195)..(195): n is a, c, g, or t
  misc_feature (199)..(200): n is a, c, g, or t
  misc_feature (269)..(269): n is a, c, g, or t
  misc_feature (575)..(576): n is a, c, g, or t
  misc_feature (587)..(588): n is a, c, g, or t
  misc_feature (593)..(594): n is a, c, g, or t
  misc_feature (596)..(597): n is a, c, g, or t
  misc_feature (611)..(611): n is a, c, g, or t
  misc_feature (615)..(616): n is a, c, g, or t
  misc_feature (627)..(627): n is a, c, g, or t
  misc_feature (635)..(635): n is a, c, g, or t
  misc_feature (640)..(640): n is a, c, g, or t
  misc_feature (645)..(645): n is a, c, g, or t
  misc_feature (647)..(647): n is a, c, g, or t
  misc_feature (649)..(649): n is a, c, g, or t
  misc_feature (651)..(656): n is a, c, g, or t
  misc_feature (659)..(660): n is a, c, g, or t
  misc_feature (680)..(680): n is a, c, g, or t
  misc_feature (682)..(682): n is a, c, g, or t
  misc_feature (684)..(684): n is a, c, g, or t
  misc_feature (688)..(693): n is a, c, g, or t
  unsure (1)..(696): unsure at all n locations
atattatatctgtagctgagctaatgttttagccgctcgcctgntcctgctaaattggcattttgaaatctgttcttgtttcaggactcctatgtggttcaaaaggatgctatcaccgtcgaagaagactgaaaatagtccagtatttaggttttttatggatctgaatgatgcaggtaatgctgtctctatacntttnnttgttcttctctgtttgatgcttgtgaccttagctgttatttaaagtctgttcaaaccattcagtcagngacaataaaaatttcctgaatccagttctcgtctttggatttctaggtcaataaatgtcctgaacccaaacctgagtgcaaagcatccctatcttttggaaccgctaaacatgtatagttaattctgaaatggactgtgaccagctctggcaagacaaaaaggtccacagttgcttattgacctattgggcaggttaaaaaacacccactttggttcctagttctctggatgtagtttacactttcttttgatggtggtaggttgcaatatcttgtaccaagaaaagatgatttatttctaagcannatttactcgtnntattnncnnaagacacttgattnctcnncagtacctttnctataacnatgtnctgcnantntnnnnnnctnnagcttatttagtgagtctgnangnatgnnnnnnact

SEQ ID NO: 365 - DNA, 526 bp, Zea mays
  misc_feature (206)..(235): n is a, c, g, or t
  misc_feature (292)..(292): n is a, c, g, or t
  misc_feature (334)..(334): n is a, c, g, or t
  misc_feature (421)..(421): n is a, c, g, or t
  misc_feature (462)..(462): n is a, c, g, or t
  unsure (1)..(526): unsure at all n locations
gtagctagcaattaacaggaaggaagtaaaacatttgtagttatcttgtttattgtgggttgccttttgttccaaactgatgaaaatactaacttaattgggaatgatgttctattaagtttgctatttacctccgaatggttttttgtgctcctgaattttgtttgtggtcaatatgtttgttatactttccatatgaaatcccnnnnnnnnnnnnnnnnnnnnnnnnnnnnnnctactcagttgacagatgagatatccaacactgggctccagtctgaattaggacacnagtttttatggggtgaacctcagatcaggtgaatcaactcgnctaaataatttggccaaatattcagtttactatcatatgtgcttagtaaaattttgtttggcatcactggtatatatcgcttacttntagatgtaatatgctgaaagaaaaaattacagaaatgatgnttttgtagggatcctttccttctttgtagttctgaacttgtataaatttgcttttattcgatca

SEQ ID NO: 366 - DNA, 671 bp, Zea mays
  misc_feature (427)..(427): n is a, c, g, or t
  misc_feature (621)..(622): n is a, c, g, or t
  misc_feature (627)..(628): n is a, c, g, or t
  misc_feature (640)..(640): n is a, c, g, or t
  misc_feature (664)..(664): n is a, c, g, or t
  unsure (1)..(671): unsure at all n locations
tttaaagtgcattgatgctatttttaccccaaagttccctatgaagcaaggatgcagctacactgtgcggtgatgaccatcaaattgaggaaaattgggctgaggtaaggatgcagctagatgaggaggataaaataaaattaaatatacatacaacatttgaggctatagaggacacgattataaatgggtcaggttgctacagtggtggcggtttgagtgcgacactatgcggtgacaggagttgtctatggatagcgtggcggggatgatggtcccataaaatattaggtagtgtttggttgaagagccaagtaggacgaaaccgttctttcccagttttattgctgtttggttacaaaggaactagaacggaatggctccaattagagaatattctcttcagatctggaaccattccgctccnaaaaaatcaaccggacggagccgctccgttcctatcccgctctcacagtcacgctccgctccgatcactctacaaccaaacaaaaaacagagtcgctccgttccagattaccaaacacagaacagagcggctccgttcctagaatcagggatggaacagctccgttctacttggctcctcaaccaaacacgacnngaacnntgattagcgtgncgggagataatgggcctgtagtanaaataca

SEQ ID NO: 367 - DNA, 1138 bp, Zea mays
  misc_feature (1)..(6): n is a, c, g, or t
  misc_feature (376)..(386): n is a, c, g, or t
  misc_feature (592)..(592): n is a, c, g, or t
  misc_feature (596)..(597): n is a, c, g, or t
  misc_feature (601)..(604): n is a, c, g, or t
  misc_feature (674)..(678): n is a, c, g, or t
  misc_feature (701)..(706): n is a, c, g, or t
  misc_feature (709)..(718): n is a, c, g, or t
  misc_feature (722)..(722): n is a, c, g, or t
  misc_feature (726)..(731): n is a, c, g, or t
  misc_feature (763)..(764): n is a, c, g, or t
  misc_feature (781)..(781): n is a, c, g, or t
  misc_feature (783)..(783): n is a, c, g, or t
  misc_feature (786)..(810): n is a, c, g, or t
  misc_feature (817)..(821): n is a, c, g, or t
  misc_feature (824)..(831): n is a, c, g, or t
  misc_feature (838)..(847): n is a, c, g, or t
  misc_feature (852)..(862): n is a, c, g, or t
  misc_feature (866)..(874): n is a, c, g, or t
  misc_feature (876)..(879): n is a, c, g, or t
  misc_feature (930)..(935): n is a, c, g, or t
  misc_feature (1108)..(1118): n is a, c, g, or t
  unsure (1)..(1138): unsure at all n locations
nnnnnnggaagaaaattttacgccacatgtcagtactcgagcaagctaagcaattaaacttccagggagataaactagcgtgcagagtattgctgaactacactaacccttctttgcatatattcaacttcagcatacaagagctcattctgcatgcaagaaataaagggtgtattaattgctcatcagcacaaaagtcaaaatcgattacttaaaagcatattggttcctcataggcttggatgtatatatatgcacagctgcacacatttctagtctttgaaacaaattgcaaaaatgcctactttcattaggattttttttaaaatattagtgtcctcatttaaactgacaaaagaaggttacacatatactnnnnnnnnnnnacaagctattttacatatctgtaccacagacagatatatcacacagttacttaatgcatacctttctagctctaatcttgtttatggccttctccagcttgccctccatctgcttaagctccctgaggcccatggtgtggattgaatctcccactatggtcctactagaccatttaaacaagttagactgcatatactactacacntttnnttgnnnngtaaaagaaaagccgaaacattgtatattagatttgtagaatttggtctaaatttgattgctgatacctnnnnncgttttgcaagctatcgatcgcnnnnnncannnnnnnnnnctcntgcnnnnnntgctgcaagttaaagtatggatatatatatanncagtcatcaaataaagntnctnnnnnnnnnnnnnnnnnnnnnnnnnccttatnnnnnttnnnnnnnnagtacannnnnnnnnnagaannnnnnnnnnnatgnnnnnnnnngnnnnagctgaggaactattcatgatatactagctgactagctagatgccaaatcnnnnnntgttgtttgcatcagtgaagcacagataagctccttgcaaaaaagcccttaaacatttctcaattttattttacgtttaaacagttatgtatataaactgaatatctttggacagaatcgttatgcagccatttcctaggatttccccatatgaataccggcgtggtttttannnnnnnnnnntaatcatgcccataaaaagc

SEQ ID NO: 368 - DNA, 1291 bp, Zea mays
  misc_feature (1)..(2): n is a, c, g, or t
  misc_feature (603)..(603): n is a, c, g, or t
  misc_feature (605)..(605): n is a, c, g, or t
  misc_feature (607)..(608): n is a, c, g, or t
  misc_feature (615)..(616): n is a, c, g, or t
  misc_feature (765)..(773): n is a, c, g, or t
  misc_feature (916)..(916): n is a, c, g, or t
  misc_feature (918)..(918): n is a, c, g, or t
  misc_feature (965)..(1046): n is a, c, g, or t
  misc_feature (1084)..(1084): n is a, c, g, or t
  misc_feature (1096)..(1096): n is a, c, g, or t
  misc_feature (1220)..(1220): n is a, c, g, or t
  misc_feature (1281)..(1281): n is a, c, g, or t
  unsure (1)..(1291): unsure at all n locations
nngccgcaacctgctgcactggacgctgcgccaggaagccacgtgcagccgcttacagtcatgttgccgccgctgatcggcagtcagactccacctttgccgcgagtagatcacggagctagaggatagcagatcgggcctgctccaaatatacacgtggtaggcgggcttgaaagcggtcctggtagtcgaccaccgagcccgttcggcggcatgcagcaagctcgtcgagcgggtttgaacgcacgggggtccgaagcgcaggttcaggagttcggagaagcggcgccatgatggagtgccctcatcttgctgtatttggatgaaccacagctaggcgacatcgtcgaggttgtaggaggccattcacacgcgttcctcgtcgatgatgcgttgttgatggaagtaggactcacatcgattaaggaacaccaatgaatcagttttgccatcatactttgggaagtccaacttctggaaccgtgggggtcaatcctggtgatgatcgccagacgccggtgtgttgtcccttcccggcttcccgcccagggcagaggactcgattcgatggtcctactggagttcggtgaccgacaacttgangnannctacagnngctacaagggattgcatgatggtgactaggtcggatgtgttgggttccgccatagcagccatagcagaggttgatgaggttgcgtcgaatggtggtgaagagatggatttaggtgacagaagtggtggagaggatgacctggaatctgnnnnnnnnngttatggatcctagttcataaggggataaacagcgccaagaagatagatgggtggagtcagcttgggagagactagagtattagagaggtctggaactaattcttctttattgattgattcccccttaggagatacaactcancnttatatagatagaaagacttggcccccaagtaactaactcaattttnnnnnnnnnnnnnnnnnnnnnnnnnnnnnnnnnnnnnnnnnnnnnnnnnnnnnnnnnnnnnnnnnnnnnnnnnnnnnnnnnnttatccactaatcctaatcatgagcctatccctacagncctccatgctcngggctgccgccccatggcaaacgatttacaggattttggttaatggccaaatctcggcatcagtatttgcatagagctgaaccaggatcctgaaacccaatatcaggcttgaagggtgtgaaantgtgtatggtgtggtttttagtaacctgaccaatctttgtgacagcataaagcagatacanagtgatgcag

SEQ ID NO: 369 - DNA, 230 bp, Zea mays
  misc_feature (105)..(105): n is a, c, g, or t
  misc_feature (226)..(226): n is a, c, g, or t
  unsure (1)..(230): unsure at all n locations
taagtccctcgagcataggatcagttccgtgaacggctccaggttgatgaagaggacgttgagttagaggaaaatcttgatccacgccagcgatcagtatcttgncgtgatgagggtgcatccagtcgtgcaggaggaccatcttgcctgagcggaccacgtgaaccccagcgatcttcatcgcggctgccagaagggatgctgctgctatcaccaccgcgttaanactt

SEQ ID NO: 370 - DNA, 247 bp, Zea mays
  misc_feature (161)..(161): n is a, c, g, or t
  misc_feature (170)..(171): n is a, c, g, or t
  unsure (1)..(247): unsure at all n locations
ctgctgttaaatttgctgtctcataacgagctacctcctcatcacagacacttaatataactccagctccattggcaacagcccatctaggggtggaaggcataagttgtgggtgctttccagatcctcggctgtaagctaaatcacccagggatatgttnatttttttnnccatacacaacaaacattatcgactactacctacatcccaaaatatagatacttctggctgggtttgtccaaaata

SEQ ID NO: 371 - DNA, 584 bp, Zea mays
  misc_feature (38)..(38): n is a, c, g, or t
  misc_feature (74)..(74): n is a, c, g, or t
  misc_feature (130)..(130): n is a, c, g, or t
  misc_feature (152)..(152): n is a, c, g, or t
  misc_feature (269)..(269): n is a, c, g, or t
  misc_feature (341)..(345): n is a, c, g, or t
  misc_feature (399)..(399): n is a, c, g, or t
  misc_feature (403)..(403): n is a, c, g, or t
  misc_feature (433)..(433): n is a, c, g, or t
  misc_feature (436)..(436): n is a, c, g, or t
  misc_feature (442)..(442): n is a, c, g, or t
  misc_feature (452)..(452): n is a, c, g, or t
  misc_feature (458)..(458): n is a, c, g, or t
  misc_feature (461)..(461): n is a, c, g, or t
  misc_feature (476)..(476): n is a, c, g, or t
  misc_feature (480)..(480): n is a, c, g, or t
  misc_feature (482)..(485): n is a, c, g, or t
  misc_feature (487)..(488): n is a, c, g, or t
  misc_feature (490)..(491): n is a, c, g, or t
  misc_feature (493)..(498): n is a, c, g, or t
  misc_feature (500)..(507): n is a, c, g, or t
  misc_feature (509)..(512): n is a, c, g, or t
  misc_feature (514)..(516): n is a, c, g, or t
  misc_feature (536)..(538): n is a, c, g, or t
  misc_feature (540)..(552): n is a, c, g, or t
  misc_feature (560)..(565): n is a, c, g, or t
  misc_feature (575)..(583): n is a, c, g, or t
  unsure (1)..(584): unsure at all n locations
atatgagtaccgaacatcgtcttaacttgttgctaaancaactgtttgaaccatttgaagctttcgtttcaagntgtcttggcctgtaaactattccgaattttcaagttccttgaggattgaaaaaaancctagaaagcttcctcagtcanttctgggtgtatattgcaagtcgttttgactcttttagatactcgtgcaaaatagtatttgcatctacaaaagacaaaacggcttacacttaaattaggaacggagggagtagaggntatgcttctgctgcttccctggcagagcacctgcatagcctgcttaatcgatcgcatgtcatgtatgtggtnnnnnacttgttagatctagatctggacatgggtcgcccgacccgactaacacaacggnttanactcaacacttccgatagagagacatggcnaanttgacnccgacactanacacangtnaggtgcagactgtgntaantnnnncnngnncnnnnnnannnnnnnncnnnntnnnttgcatgacactgaactctnnntnnnnnnnnnnnnnccctttannnnnncatatgaaannnnnnnnng

SEQ ID NO: 372 - DNA, 639 bp, Zea mays
  misc_feature (633)..(633): n is a, c, g, or t
  unsure (1)..(639): unsure at all n locations
ttgataaacccctcaactgactggaggggtggtgttggttttgtatcaaaggacatggttttgaaaggtttgccaggcccagcggaggactctctgattcttgtgagtagttcatgaattcatgacacatctgctgaggagtttcttcttctgaatatttgtgtttttgttaacaaagtcactttgattaatgttaatgtaagaggtatgcaagagccctcgtaaacttaattcttttatatcaccatatagggtgcatttgtaacaaaaaaaatccctcatagatatttctctccaacagtttctctatatcaaatgacatataaggcggataacatatcaccctgtatttgagggagagggtgatttaggacagcactaaatataggatgttggagggtgatttttgctgcatactccttaactttgatttaaaaggtcagataggggaactcctggagatgctctaatgttgctaatgatttactgcactgtctttatttctggtggaattaacttcataatttgtgttggactgttaatagcttctgtttttcatgttttttgtttattcaggtttgtggtccaccaggaatgatgaatcacatatctggagacaaggccaaggataanatccca

SEQ ID NO: 373 - DNA, 542 bp, Zea mays
  misc_feature (1)..(4): n is a, c, g, or t
  misc_feature (29)..(29): n is a, c, g, or t
  misc_feature (44)..(44): n is a, c, g, or t
  misc_feature (51)..(51): n is a, c, g, or t
  misc_feature (55)..(55): n is a, c, g, or t
  misc_feature (61)..(62): n is a, c, g, or t
  misc_feature (192)..(192): n is a, c, g, or t
  misc_feature (301)..(301): n is a, c, g, or t
  misc_feature (403)..(490): n is a, c, g, or t
  misc_feature (516)..(516): n is a, c, g, or t
  misc_feature (532)..(538): n is a, c, g, or t
  unsure (1)..(542): unsure at all n locations
nnnnaagttgccgccggcaggttacgaancagcaaaccaagcgnggggaanaaanagaganngaggaaaaattgcagcttcccctcgcaggagaatggcctcacctgcgcagcggagagcctgggcgccgggtggagcctggtggcccacatgaggaagatgagcagggagccgaacgcgagctggaaggcngtgatggtgtacggcagcggcaacggcagcgcgccgagaacctgcaacgggggacgacggttggtgttgatcatcaggggggagaagagtggaggggatctgaggatcncttgagatgctgcggtgaacggccgccggccagacctgcttgttgtagatgttgaagtagatgttgagcaggtaccacgcgacgatcatggcgcccagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcgacctccccattctttccgcngccggacagcagcggnnnnnnnctga

SEQ ID NO: 374 - DNA, 707 bp, Zea mays
  misc_feature (86)..(86): n is a, c, g, or t
  misc_feature (160)..(160): n is a, c, g, or t
  misc_feature (184)..(184): n is a, c, g, or t
  misc_feature (221)..(222): n is a, c, g, or t
  misc_feature (241)..(241): n is a, c, g, or t
  misc_feature (294)..(294): n is a, c, g, or t
  misc_feature (370)..(370): n is a, c, g, or t
  misc_feature (401)..(401): n is a, c, g, or t
  misc_feature (447)..(447): n is a, c, g, or t
  misc_feature (495)..(495): n is a, c, g, or t
  misc_feature (511)..(512): n is a, c, g, or t
  misc_feature (516)..(518): n is a, c, g, or t
  misc_feature (521)..(521): n is a, c, g, or t
  misc_feature (576)..(578): n is a, c, g, or t
  misc_feature (604)..(604): n is a, c, g, or t
  misc_feature (606)..(610): n is a, c, g, or t
  misc_feature (621)..(622): n is a, c, g, or t
  misc_feature (638)..(638): n is a, c, g, or t
  misc_feature (640)..(642): n is a, c, g, or t
  misc_feature (646)..(647): n is a, c, g, or t
  misc_feature (653)..(664): n is a, c, g, or t
  misc_feature (668)..(676): n is a, c, g, or t
  misc_feature (680)..(681): n is a, c, g, or t
  misc_feature (688)..(689): n is a, c, g, or t
  misc_feature (693)..(703): n is a, c, g, or t
  unsure (1)..(707): unsure at all n locations
tatcagcaccaacatcggtcttactgggtggctgccagcctcaatagtgaatctctcgacgaccatgcaaggcctcatgttggctnacacagggatcgtaggaagcatccccttagaaattggcaatcttttcaacctccagttcttcagcgtgtcaaanacttccgtgtctggtgcggtaccngatagcattggcaagctggtaaacttggttgaattanncctgtacaataccaatctntcagggcttataccttcatctattggaaatctttcagagttagctgcgcttgntgcattcaatagcaatctggagggaccaattcccaaaagcatagggaggctgaagaacctctatgcccttgatatntcaagtaaccgcctaaacggttcaattcccntcgagattttccagctaccactcctttctagatacttaggcttatnacataattcattatcaggtaccctacccgctgaggttggtagcttganaaaccttaacatcctnncgcnnnctngaaaccaactgtctggtgagatacctggtagcattggggactgcaccgtgttgcnnnaacttgggctggatgacaacttattngnnnnngccatacctcnntctctgagcaatatanannncctnnctggannnnnnnnnnnnatgnnnnnnnnntctnncgtcatnnctgnnnnnnnnnnnagca

SEQ ID NO: 375 - DNA, 621 bp, Zea mays
  misc_feature (192)..(192): n is a, c, g, or t
  misc_feature (258)..(258): n is a, c, g, or t
  misc_feature (378)..(378): n is a, c, g, or t
  misc_feature (413)..(416): n is a, c, g, or t
  misc_feature (422)..(422): n is a, c, g, or t
  misc_feature (554)..(554): n is a, c, g, or t
  unsure (1)..(621): unsure at all n locations
attgaggaattttcagcagatgacatttgtctgggatctcattttactgaaacaccttcgaaatctgcagcacaaaatggaaaactgcaccacaaatctatggaggtgatcggtcttgttcgtgatagataaggaacaacgaaacacctgtgaaattttatcagtttgttcttatattactatgatggcacntctgcaggttattccattcggatttgtttttgaagatgatactctccttgaagcatctgacagctnagtagaacctcacttgcgacatctgccatgtaacagcgttcttgatgttgaccggcttcttaattcggtatctacttatctcctggttcttctacattgttcaaaatgctctggaaaaangagcatttttaatagaagttaataaattctaagannnnttatantttatgtataggttttggaaacatctcagcatgttggaaggatgtcagtttcaacagaccaggatttgcctttcaaggaggtagccaaccaatgtgaagcacttctgattgggaagcagcaaaagctatctntctgcatgagtgttcgtgaaaaaaaggttagagatcgtgagcagcttgagctgtccacacaggggga

SEQ ID NO: 376 - DNA, 502 bp, Zea mays
gcaatattcatgagatcagatctgaatttatctgcagaagaatgaaaaagaatattttcatgagattgatgggcatggtggcatattcctgagagaatccatgagatgcaagataaagtgaatttgaatccatatgagattaaatattactcaagaataacaaattattattgacgtcaaatcctacatgctatgcaaaatacaaatttattgataaggaaaagaatggctcaaataagatggtgtcttatgaacactgaaaaactatgctttccaaccatgagattgagaaaataacttacctgtattttctttgttgtccatggtcttttttagcaaagaatctctggcacactcgagagccattctgtaacctaaaattttacaggatgaattaagtgctggagacgttgaatctcatcataaaaaacaatggttgtagctttgcagcagtgatctagaatgcatactagtagttcctcagaatacacactagctatct

SEQ ID NO: 377 - DNA, 709 bp, Zea mays
acaatataacaagttagcgacacaagttttgtacttcaagtcttttaactatatgttggtgcaataagattatgagtaatccatatgaaggtgttgcaagcgaatatgaaaggcaaagataaacggatgaacccattactagctttggctgtatcagaccaataacttgaaatgcacttgtgctagcatgcctaagtattagaaaaggtagcatgggagaatctatattattttggctaacttctttagttactattgattgatgagaaagcctaccattgcccatgccagccctaatgtcccggtgacatgattgagccagtactatgattaatttactctattgttctccttttttgagtgctgtataagatgtcctttttttgagccactcgagaagatgtttacttaactctagtgcgcaatgattggagctctcagtgcaacgcatgtgctctgtaatctactgtcaccactaccctgtagtgtgtgcttaaactctaaactattccacgtggctagtaattaccaatcatttacaacactgttacatgtgtagggctgcgatgcttcggtgctgttggacaacagcagcagcatagttagtgagaaagggtccaacccgaacaggaactccctcaaggggtgggaggcgatcgaccacataaaggctggtcttgaagctgactggccaggcacaagattctgt

SEQ ID NO: 378 - DNA, 685 bp, Zea mays
  misc_feature (112)..(112): n is a, c, g, or t
  misc_feature (238)..(238): n is a, c, g, or t
  misc_feature (464)..(464): n is a, c, g, or t
  misc_feature (543)..(547): n is a, c, g, or t
  misc_feature (571)..(574): n is a, c, g, or t
  misc_feature (576)..(578): n is a, c, g, or t
  misc_feature (583)..(585): n is a, c, g, or t
  misc_feature (591)..(592): n is a, c, g, or t
  misc_feature (594)..(601): n is a, c, g, or t
  misc_feature (603)..(604): n is a, c, g, or t
  misc_feature (613)..(614): n is a, c, g, or t
  misc_feature (623)..(639): n is a, c, g, or t
  misc_feature (654)..(669): n is a, c, g, or t
  misc_feature (671)..(673): n is a, c, g, or t
  misc_feature (679)..(683): n is a, c, g, or t
  unsure (1)..(685): unsure at all n locations
gctcaacaatgaccactgagggcactgaagtcgcttgatgtgctgaattgttcgtgatgttggtggcgtattttgtttaaataagtaagcatggctgtgattttatcatatnatcgatctttggggttttatttaacacattgtaaaatgtgtatctattaataactcaatgtataagatgtgttcattcttcggttgccatagatctgcttatttgacctgtgatgttttgactccnaaaaccaaaatcacaactcaataaactcatggaatatgtccacctgtttcttgaagagttcatctaccattccagttggcatttatcagtgttgcagcggcgctgtgctttgtaacataacaattgttcaggcattatatccaaatctagaggcctaccaaaatgagataacaagccaactaatctgctgggaaataggtaacaagtctctaacaagatcttaagnttattctgagatgatgtcgagaccgatgccttttgttacgtcgtgccgtgcctcttgttgccatgctggtaagttgctnnnnnttgatgagggcaagctgcttatcnnnncnnnatgannngttatnnannnnnnnntnngtgctgctnncttggcatnnnnnnnnnnnnnnnnncccatctacctgcannnnnnnnnnnnnnnncnnnactgcnnnnntg

SEQ ID NO: 379 - DNA, 801 bp, Zea mays
  misc_feature (19)..(19): n is a, c, g, or t
  misc_feature (45)..(45): n is a, c, g, or t
  misc_feature (85)..(85): n is a, c, g, or t
  misc_feature (90)..(90): n is a, c, g, or t
  misc_feature (266)..(266): n is a, c, g, or t
  misc_feature (429)..(429): n is a, c, g, or t
  misc_feature (435)..(435): n is a, c, g, or t
  misc_feature (470)..(470): n is a, c, g, or t
  misc_feature (607)..(607): n is a, c, g, or t
  misc_feature (614)..(614): n is a, c, g, or t
  misc_feature (778)..(782): n is a, c, g, or t
  misc_feature (790)..(797): n is a, c, g, or t
  unsure (1)..(801): unsure at all n locations
ctggctcgtggaagtaagnttttttttgtctcaaagtaagaaaancctaaagaacaatcttgtcaacttgtattcattattttcncctcntgcaggttgctgaagaatatcgtcttgttcctgatactttgtacctgacagtcaactacattgaccgttatctttctggcaacgaaatcagccgccaacggctgcaattacttggtgttgcatgcatgcttatagctgcgtaagattctgcttctctttccatttattatccttanttgtcattacgatgttagcgtactgatttggcatgttgggaacttcaaattcagaaaatacgaggagatatgtgcaccacaagtagaagaattctgctacataacagacaatacatatttcagagatgaggtttgtgacatgtttacttcctatcgttctttnaaaaantacagcagaccatatcgaatagtcccttgtttgtnactgtcactaaataacttgtacgttaacaggttctagatatggaagcttctgtactgaattacttgaagtttgaaatgacagcacctacagcaaagtgctttttgaggtgattatccccgttttttattttagaaanaaatatnatgattattctaatctaacttgccactaactcttatcttttctttttttgcttacaataggagatttgctcgtgctgcacaagcgtgtgatgaggtactgctatatagtcagcttctggttactggaaggaattcctcaagttacagatatgagaacaattcgnnnnnaatctctnnnnnnnnagga

SEQ ID NO: 380 - DNA, 1270 bp, Zea mays
  misc_feature (79)..(108): n is a, c, g, or t
  misc_feature (143)..(144): n is a, c, g, or t
  misc_feature (163)..(163): n is a, c, g, or t
  misc_feature (250)..(250): n is a, c, g, or t
  misc_feature (305)..(305): n is a, c, g, or t
  misc_feature (396)..(492): n is a, c, g, or t
  misc_feature (495)..(495): n is a, c, g, or t
  misc_feature (722)..(722): n is a, c, g, or t
  misc_feature (724)..(724): n is a, c, g, or t
  misc_feature (828)..(828): n is a, c, g, or t
  misc_feature (905)..(905): n is a, c, g, or t
  unsure (1)..(1270): unsure at all n locations
gcctgcagttatggtgaccttttaggtggtcatcttgttttgttgtggccggatggccatgattattaatttttcttcnnnnnnnnnnnnnnnnnnnnnnnnnnnnnngtgtttgtatttggtctatttttagaccctccttnnttcttaattcaatgatacncagctctcctgcgtgttcgagaaaaaaaattgtagaatgctagataggctgattttgttgtatattttctagagctagagaaacacnaaaagtgctgatcatcttggtcagatagagtcacttcatgtaggatatcccaaanttgaaaaaattgaaaaaggccaaccattgacaaacatttcatgtaggatatcccaaaaaaagggcgtacccaatgccgtaggcttcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgntaggctctaccgctgcaccatgcccacccttctcatgttggatatcccaaagttgaaaaaattgaaaaaggccaaccattgacaaattaccctgggtatcagaaaaccatctctagtcccctaaagcatcaaccacaaatatttttctcttgaatgtaatttaaaccgcctcgaacgtagctggagcaacatcagctatgctacgacccatcagctatctgacggancngaaaagggtcgtcaaatcattaccaaccatagtaacgattgcaatggaaaaaggatgttgctttcttgtgaactagtatctctaagccattccaagttctcggngccccagttttttctaaccagagccaacggacttgcagagcccaactcatgagcacaaatttagacaccttatcccnaaccacaagacatgaaccaccattaatttgttgtctacctttccataagaaagctcttcttgatttatcgattgctttgatgaaccattttgggaccttgataactagcagcacatgaataggaattgcagtcaagacaaatttcacccaagtagctcttccagccattttcataaggcctactttgcaggaagtttgttatctatcttctcgacccatgaccaaggagcgaattttgttaactttctgttggagatgggtaaccctaaataagtacatgagaactttgagcgcacacaacggatggtttgctcaaccacctccatatggtctgaaccgcgttaaaaaggaattacacaactttt

SEQ ID NO: 381 - DNA, 553 bp, Zea mays
ccggtgctgggaaacagaagcgttgagagggttttgagggggcggcggctgtgccttttactctactgtagacgggccaaaaatagaagcccacaaataaaaccctagcccagtaaaacctggtcagtttctcgcctaatcggatgactaattgctctgggtcgatgattagttggacgccaggacgacgaggacacctggtcgggtcaccgatcctgatcgtgcccttccaggcgacctagacgactaatcgcgattagttggatgacttgaaaacaatgtcaactacgacgttgacacatctgtagcaacagcatgacacttttccctttatccgtggtttgttttcaaactgctatactacacaggtttgtgtttaggatgctccctacatatgcataatcattttttagtttgtgaaaatgtggtgagtcaataacttccaagttagttgagagtcatgagaattttttttttctgaacaattgctgtcttttcttgttttagtgtaatataagatgttctcagttatcattttttggacatgaaagca

SEQ ID NO: 382 - DNA, 537 bp, Zea mays
  misc_feature (212)..(212): n is a, c, g, or t
  misc_feature (269)..(270): n is a, c, g, or t
  misc_feature (314)..(315): n is a, c, g, or t
  misc_feature (358)..(358): n is a, c, g, or t
  misc_feature (377)..(377): n is a, c, g, or t
  unsure (1)..(537): unsure at all n locations
cgggcagcaggaagcctggtgttgtggtctaggcatggccaaacagcagtttagaaggatatggaagggttggaatggggaggaagagaacacgagagaagaatgttgctaacgtgtgtgcccatgatgcagaatggatgacgtggatgctaacacggcaaaactagtgccatgtaggatagaaatcagcttcaaatgggcttgggtgtggntgacacagagggggcgaggggtttgtggtcttacaagttataagatgggtgtgtgtnntggggaggggggataaattggacttctcttataattttcatatnncaaatttctatctaatacttgcactggtgggtactgcaggacnttgaacgacaacacacctngacaaaatattatgcatgttaacttttttatttcatagttcgatatttcaataatttgtgagggtcaacatttctgctatggctgttggttttctgtgtacatttgcccatcaatatttgctgctgttacttgttttcatttttaaaccagaacatcatc

SEQ ID NO: 383 - DNA, 658 bp, Zea mays
  misc_feature (118)..(118): n is a, c, g, or t
  misc_feature (228)..(228): n is a, c, g, or t
  misc_feature (254)..(254): n is a, c, g, or t
  misc_feature (325)..(325): n is a, c, g, or t
  misc_feature (488)..(488): n is a, c, g, or t
  misc_feature (507)..(507): n is a, c, g, or t
  misc_feature (626)..(626): n is a, c, g, or t
  unsure (1)..(658): unsure at all n locations
gctcggtacccctgctggctcattgagccataggctcggtgcaagagagcgcagttgcaactccaggcaacaagaggatagctttagtgtccttgttaatgcaggcagcggcagcgangggcacatcattttcaccttgcagatcaactgctctttcattggcaacttgcagtggtgcagtgtcacagagcagagtgcagtgcacgtccctgtgcagttttgtgtggncatggacgattgagacatgtccatgnacctgacactgctcaccttgcatgaacatgccttcgcggcgttcgtactctcacagcctatgatggctgcntcatcgcctcattggctaattgacagtgctgtcggataggatctggcattctggccttcatctgcgatgacaccaccatcatttgtggaaggtgacgcatggacttcgttgagctcaggggcggcgctaggaagcagtatgcagcaatggggtgtactgctanggctcatactctggcttcnctctatttggttgctttcctaattccttctcaatgaccttgctggtgctagcataaactgaagtggacaaagaagggaagggaacacagaaagcaaagacgagaactagaggatggaanaacaacagagtatggacactggtttcggcaca

SEQ ID NO: 384 - DNA, 920 bp, Zea mays
  misc_feature (5)..(38): n is a, c, g, or t
  misc_feature (230)..(233): n is a, c, g, or t
  misc_feature (887)..(916): n is a, c, g, or t
  unsure (1)..(920): unsure at all n locations
ttttnnnnnnnnnnnnnnnnnnnnnnnnnnnnnnnnnnaagaactcagctgggatgtcgatgatgatgatgttgaagatgccaatactagtgatcacaaagacagcacaaactcgttggtagataagaaagaggagcaagcagcggagcctgttaactgtgaaacagagggcagtatggaacaagaagcagcattttaaaatgatttggccgacgataaggaggttgctnnnnctgcagccaaggatggtaacggtgaatcaagttttgaagcatcgactccaaaggcaagcaatgggaccagacaagaagagaagattgaggctgctgactcatctaaggggggtgacccacgagtggggcctcaaccattagtgcaggaggaagatcttagctgggaggagattgaggatgttggcgatgaagatcagaagaatggggttagcaaacggtcaagctctgtcagcaaagtggaggatctccggagacgtcttaattctgtggaagatgatgatgaggacctaagttgggatgtcgatgagtagaaagaacgtgtggagccctgcactgagttgtctgaaggacttctaaattagagagactgccatcctaagcataaattgaatctgtatggtgccgatgaagaagctttgtggatggattgccacaatgtgaatattgtgatggacactggtgattcaaattcagtgggggctcattagtttccttgcaagaactcgatagaatggtagtgttttttctgttagtgttggtaatttgtttccagttagcatacgtttgttgcaagtccaacatgtaccaccttcctgtttgaatatgacacatagttcatttcagattcacaaagtaaacaaaaaaattgtgaannnnnnnnnnnnnnnnnnnnnnnnnnnnnnacac

SEQ ID NO: 385 - DNA, 1977 bp, Zea mays
tataccaaatatgccaagttgcaacaaacagcctaggctggaactcaaaactgtactatccacgcggttctcctcttacatttctcaacatcacgaaaattaggaaccaataacaaacccattatacaatctctgccattgttcccacagcagcaagcggcagcaatcagtatcggctataatcctgtatacatgccccctaccaaaaatctttttttatgtactcgctttgctctacaaattaagcaaactatcctagcaggggccatcatactagacacgatgaaaaaaccaacacacatgcttggttgcttggaagcaaagcctcgagaagaaccaatagacaacagcagtaacaacactgaaggttgacgtggcattcatgggcttgtataggcctcagcacaggcagcaactatattcctctgccaatttttctgttctaagcctcatcatcttgggcatactgttgtcgaggcctccgtcaatcgattgaaactttaagttttctcaattataaattttcacgggcttctcataggtgtgccgattctgattggctgtgtaagaccttttcgatgttgtatcggtgtgctccaagccaaggtattgttcccaagcaccatatacatctctcctctgaaaacgtgctgatacaacatcagtgtcctggaggtactctggccggttcatggatatgaatgcaagcttccacttggagaagtcctcatccggaactctaacggtagagctggtgtaaaaaaggtgagacagacgaattttatttagatcgtatatttgtatggtgacactcgcaaccgcatttttttgacataaaaacacgagtagctcagaatcatataacggctccttgagatttttccaatacgtatcagaacttgctaaagaactcgcagatgtgatcagagacctcgttgggtttctcctggttgatgaagtggctcactccctccataacaaccacgtcctctagatttggcacgcttgccttgaagccacccttgtgaatgtagtccggtacccccggagcgttgtatgtaatgtcaaggtccccaacaatgaatttcgacggaacttttatcggagctccagtccatgccgcagaaagctcccaactcctgtctatgcacctgtagtagttaagtcctccagtaaagcctgttttcgcaaatttttctgcatagtaagaaatatcttcctctgatagccatggaggacaagttccatctgaatcaagagagtcaaagaagctcttgtccttgggcagaataagaggagctggcttgcgcatgccaaatgtcttcttaaacacccacttgatgtcatatagagcaaattcagcttcagcaacaccaaattcctggaagcggcacatgtagtggtcttcgccgcaggcagctctgatggcctggagcgggctcatctccggccgccgcgggtggtacacgacgcttaggttcacgagcgcccgcaccaggtccggccgaagcagacaaagctgccacgccacggtggctccccagtcgtgccccaccacgaacacctgccgctggccgaggtcggagatgagcgcgacgaggtccccgacgacatggaaggtggtgtagctggacgcatcaggcggggagtcggagtcgccgtagccgcggaggtccggggccacggcgcggtagccgcgcgccgccagggcggacatctggtggcgccagccgtaccagaggtccgggaagccgtgaaggagcagcaccactggggcgctgccctcctcgggcccagcctccgccacgtgcaggcgcactccgttcgcctccagcgttcggtgccgcaccccctccaccgcggccgccatctctatcctatgccgtcctgtctgctcaccgaagcgcactggctcaggcagctgctacctgtcgcgcacgcgcatgccgccgacgcgtgtagcgggacctgccggct

SEQ ID NO: 386 - DNA, 698 bp, Zea mays
  misc_feature (495)..(495): n is a, c, g, or t
  misc_feature (576)..(577): n is a, c, g, or t
  misc_feature (589)..(589): n is a, c, g, or t
  misc_feature (600)..(601): n is a, c, g, or t
  misc_feature (604)..(605): n is a, c, g, or t
  misc_feature (607)..(609): n is a, c, g, or t
  misc_feature (623)..(627): n is a, c, g, or t
  misc_feature (629)..(630): n is a, c, g, or t
  misc_feature (634)..(640): n is a, c, g, or t
  misc_feature (643)..(652): n is a, c, g, or t
  misc_feature (672)..(672): n is a, c, g, or t
  misc_feature (679)..(681): n is a, c, g, or t
  misc_feature (683)..(683): n is a, c, g, or t
  misc_feature (691)..(697): n is a, c, g, or t
  unsure (1)..(698): unsure at all n locations
aacgagtctgtcttcagctcaggaaccacaacggacagaatcggcatggatggcctatacttggctacaagcctagcagtagttcctcccctggtcaggaccaagataagtgctgccctggcagagtttgctgtgcgaacagctgatgatgcaaggctctccaatggactcattggaattggagctgaagccatgattgatttgaaaatagcagcatggtctacgcaagactctgcttgcaggcagatcttagccatagtctgcaccgccaactctggataagccccagcagcagtctcaccactgagcataacacagtctgtgccatcaagaactgcgtttgcaacatccgttgcttctgcccgagtagggcgaggagacttgatcatagattccaacatctgggttgcagtcacaacaggcttgccttgaatattgcacttgaaaatcatcaccttctgtgcaaagaaaatcttctctataggaatttccatncctaaatcacctcttgccaccataaaagcatcagagtttgccaggatatcatcaaagttagctactccctcttgattctcnncctgcatgttcnaaactattatnnccnngnnnttgaaaatctactnnnnngnnaccnnnnnnnaannnnnnnnnncatacctttgacatcagcantatggannngncatgctcnnnnnnna

SEQ ID NO: 387 - DNA, 690 bp, Zea mays
  misc_feature (134)..(134): n is a, c, g, or t
  misc_feature (648)..(649): n is a, c, g, or t
  misc_feature (669)..(671): n is a, c, g, or t
  misc_feature (683)..(689): n is a, c, g, or t
  unsure (1)..(690): unsure at all n locations
tgatttctcttccttattatcaccagagaccaaggaaataaggtcagcattgttctgctctttaatattactgactggagatacagacttgcacgctgtttcattttgttttcctgaaccttgaaggagacatngcttggctgcaacggactggcgctgagttgcatcagaaacatctccattagtagctatggtataatcacacaccttggtgaaatgatggtgatgagatggatccttatttctgcgtctaccagaacctacagggacatttctcatagtccccccagcagtccagtacctcttgcagtttcggcagaaatgcctgggctggttcacgttgtaattgttgaagtagcagaactttgtttccatactattgcagcgagggcaaggcagaatcttatctggcttcttgagtaccttctcttggccagatccaccagattcagtcttagcttcctcagacttggaatcgtatcttttcccaggctgactgatgatagcttgtaaactattcttagcttcctcagagttggaatcagcttccattttcccatgctgactgctgattgcctgtaaaccattcttcatattgctcttggaagggaagggatttgttttgacaatcaaagacatgtttggaanncatggcatgccatctttgcnnntaacatcatttnnnnnnnt

SEQ ID NO: 388 - DNA, 758 bp, Zea mays
  misc_feature (24)..(118): n is a, c, g, or t
  misc_feature (148)..(354): n is a, c, g, or t
  misc_feature (455)..(608): n is a, c, g, or t
  misc_feature (613)..(615): n is a, c, g, or t
  misc_feature (618)..(619): n is a, c, g, or t
  misc_feature (652)..(654): n is a, c, g, or t
  misc_feature (658)..(658): n is a, c, g, or t
  misc_feature (660)..(660): n is a, c, g, or t
  misc_feature (666)..(669): n is a, c, g, or t
  misc_feature (677)..(680): n is a, c, g, or t
  misc_feature (684)..(684): n is a, c, g, or t
  misc_feature (686)..(688): n is a, c, g, or t
  misc_feature (696)..(699): n is a, c, g, or t
  misc_feature (704)..(753): n is a, c, g, or t
  misc_feature (757)..(757): n is a, c, g, or t
  unsure (1)..(758): unsure at all n locations
tagacttagcaacaatacacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagaacttgtgcagaggaggtggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttccttagggagactaaatcatgtaacttttgggacaatctgttagccatcagctcaagatatctctccagatctgcccaaatccaagtttctgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttnnntanngagactaaatcatgtaacttttgggacaatctnnnagcnancagctnnnnatatctcnnnngatntnnncaaatccnnnnttctnnnnnnnnnnnnnnnnnnnnnnnnnnnnnnnnnnnnnnnnnnnnnnnnnnatgnc

SEQ ID NO: 389 - DNA, 775 bp, Zea mays
  misc_feature (442)..(442): n is a, c, g, or t
  misc_feature (450)..(450): n is a, c, g, or t
  misc_feature (460)..(460): n is a, c, g, or t
  misc_feature (498)..(498): n is a, c, g, or t
  misc_feature (543)..(545): n is a, c, g, or t
  misc_feature (631)..(633): n is a, c, g, or t
  misc_feature (638)..(639): n is a, c, g, or t
  misc_feature (653)..(654): n is a, c, g, or t
  misc_feature (657)..(658): n is a, c, g, or t
  misc_feature (667)..(667): n is a, c, g, or t
  misc_feature (675)..(675): n is a, c, g, or t
  misc_feature (681)..(682): n is a, c, g, or t
  misc_feature (684)..(684): n is a, c, g, or t
  misc_feature (688)..(689): n is a, c, g, or t
  misc_feature (691)..(692): n is a, c, g, or t
  misc_feature (694)..(698): n is a, c, g, or t
  misc_feature (713)..(722): n is a, c, g, or t
  misc_feature (725)..(725): n is a, c, g, or t
  misc_feature (740)..(741): n is a, c, g, or t
  misc_feature (744)..(774): n is a, c, g, or t
  unsure (1)..(775): unsure at all n locations
catgcctgcagtagcttgcattcttctatacattgtaagttcgcttcccatttggattactggaatgcacatctccttgtatccagaatgtttttgacgattcattttacccataatccaggagtacaagcacattgccaggttgaagctccttcatcttacaagcgcaacaccaaaaccaaaccattttacagttcttgttcgtggaataccaaaggcagataaagaatcatgcagtgatgttgttgataatttcttcacaaagtatcactcatctagttatctcttccatcaagtagtttacaaagtcgggaaagttcagaagataatggtacttaacactcaaatgcatttcactttttctaatgacaagcatttactagtataaacctgtttcttctgttgattagattttcgcacatatggataatcattttttttngtattttnacatgaatcngtggaaatgtctgcatttgtttttttggtggtggtggngtggaagttatgcatatttctatttcactttatttatgttttttnnnttactttaatcttcatctctgacagactggcgcaaagaaggcatataagaagttcaaacatttcacagatgaaactgtcgatcaannntgcannacagttacctaccnntgnngtctgtgtngagcttcntcaaanncnttcnngnngnnnnncactgagtgtgagcnnnnnnnnnnganagcggacaataaatnnatnnnnnnnnnnnnnnnnnnnnnnnnnnnnnnnt

SEQ ID NO: 390 - DNA, 885 bp, Zea mays
  misc_feature (1)..(21): n is a, c, g, or t
  misc_feature (24)..(36): n is a, c, g, or t
  misc_feature (38)..(112): n is a, c, g, or t
  misc_feature (114)..(174): n is a, c, g, or t
  misc_feature (182)..(192): n is a, c, g, or t
  misc_feature (436)..(442): n is a, c, g, or t
  misc_feature (461)..(464): n is a, c, g, or t
  misc_feature (511)..(511): n is a, c, g, or t
  misc_feature (519)..(519): n is a, c, g, or t
  misc_feature (797)..(797): n is a, c, g, or t
  misc_feature (838)..(843): n is a, c, g, or t
  misc_feature (860)..(882): n is a, c, g, or t
  unsure (1)..(885): unsure at all n locations
nnnnnnnnnnnnnnnnnnnnnggnnnnnnnnnnnnncnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnntgaaaacnnnnnnnnnnnttgggacggtagagttgacaggattactgatcacattcacaattgcattagggcagcattttgcaattccttcacacagggtacggactattccagcatttatgttgaacaaatcatcccttgtcatcccaggtttccgagggacaccagcaggaattattacaagatccattccagccagggcattttccaactgtggctggcccaagaagccacgtacctgtagaatttattagcataactnnnnnnnaagataaagaaaaaaatannnntaatggtgaacaagataaataattttatgtttgtaggacacagcacngggagggngggggggtatccagatagcagcgagtggtcagacattaaaaaaattaatggatatctgaagatatccaggtaaaaaaattgtgactgcatttcacaaggcaactccaatttgtctcccaagcattccagtggaaaattgtagtacttcagaacgagtcttaagtacagtagacagtagctaatatgcgtttgcagatgcaggctgcagcactttatgtcctctaaatatgacctaagaatccagttgggaaccaactgcagtagaggtgtaccatcanctagctacaacagtaatgtaccgtctcggataaagttaagnnnnnnacagcaccagtgttcannnnnnnnnnnnnnnnnnnnnnncca

SEQ ID NO: 391 - DNA, 783 bp, Zea mays
ctgcagatgctttttttttcttcttcttgtacttaatcttgttgcttgctcatgctacttcaatcatattcctccccagtggagacgccaagcatcatgcttctggctgcgcttcggaacatccgaattgtaagacttggatttagcatactgcacaaacaggcccagaactgcatttgacattgttatgtctttccagccaaggccaaccatctacaatgtggtgctggagatgactacaaggatgggatatgaggtgatgcatgtttttaagaagaaaaaaaacagtagatataatgtttggctactcatttcctttaggaatttggtacctataacaaagaggtgtccagtgaactttgatgcacattaatgatttttgtatctacttgattttgagtcacgcacctgcacaaacgcatgccagttctgtccaacacaggcaggatttgggctgaacatatatgctgaatcaccgatcgctttggctacgtactctgcgctttcaggtgcgtttggtgcggatcacagaaatggtccatgacgcatactattctcgactatatctcgcaaaggtaactgcactcccaagtaaattatgccgcaaaaacaatccttttagcttatattggtctgaaaaaagaaagcatggcaacatgacaccaggttgggaatgaccaagacactatcagtttcgacctcaagccatcggatgctatcaacattgctttccgctgcaaggtatgcatttgattcttgcattttccagtacagaggacaatc

SEQ ID NO: 392 - DNA, 701 bp, Zea mays
  misc_feature (31)..(31): n is a, c, g, or t
  misc_feature (307)..(307): n is a, c, g, or t
  misc_feature (513)..(515): n is a, c, g, or t
  misc_feature (534)..(541): n is a, c, g, or t
  misc_feature (545)..(556): n is a, c, g, or t
  misc_feature (558)..(561): n is a, c, g, or t
  misc_feature (563)..(566): n is a, c, g, or t
  misc_feature (594)..(596): n is a, c, g, or t
  misc_feature (611)..(628): n is a, c, g, or t
  misc_feature (633)..(640): n is a, c, g, or t
  misc_feature (643)..(647): n is a, c, g, or t
  misc_feature (651)..(671): n is a, c, g, or t
  misc_feature (673)..(683): n is a, c, g, or t
  misc_feature (685)..(695): n is a, c, g, or t
  unsure (1)..(701): unsure at all n locations
tggtgcctgtctatgtttcacatgttttttnatctttgtaagtcgaactcgaactcactatttcatgcctgatgttttgctcaggttgcactggagaacagatacaccaagatcatgctgggaacgtgtgcttccggaatagcatgccatgtgctatctgcaaccgtgaaggtatatatctgacccggtgatgtttgattcttcttgagaataatatgagcgagcgttgagagcataacagaattactaatttttccaggggcaaggctacgctttaccagctgatgtccagtatgttgatacgcgntgggaagtacccgtggttcttccacttcatgattgcctggcccaagagcttaacttgctctgtgaaattgataggtaaggtaaaagctcacctattagcctagttgtctgttgtccttgcagtgggtttttattataatggtttctctgttcagtttgaagacacagcaacttctcgataggccttgcagtggcatcaatggcttnnnttcatcctttgtttcacgnnnnnnnntagnnnnnnnnnnnntnnnnannnnactttcttggtgacttaaaattttagcnnntctgtatgtgagctnnnnnnnnnnnnnnnnnngatgnnnnnnnnacnnnnngtannnnnnnnnnnnnnnnnnnnngnnnnnnnnnnnannnnnnnnnnnattttc

SEQ ID NO: 393 - DNA, 420 bp, Zea mays
cctgcaactgcttgggtattgtacatctgtatgtgatgtgtcatgtgcacatgctttgccattttgcattggcaataataggttgtgcatcccttcagcgctacaaggagcaaggatgtccgcttcagattaaatccgactgtttagactgctgcaactgtaatcatagagataaatacactatagaaacagtagtaggagccgatacgaattaaaaacaacgaacaggctgaaagatgcagcgcttgtctgcacaacatccccaaagtatcttcgagtcgaatacaacagggtaactgagtgtaaccacagttcgtacagaatttgtagagaaaatgaattgtccaaaccaccggataaattcatcttgttacaatgtttgctggcagaatagctcgcacagcacaggagatgagacca

SEQ ID NO: 394 - DNA, 748 bp, Zea mays
  misc_feature (8)..(8): n is a, c, g, or t
  misc_feature (131)..(134): n is a, c, g, or t
  misc_feature (264)..(264): n is a, c, g, or t
  misc_feature (346)..(346): n is a, c, g, or t
  misc_feature (357)..(359): n is a, c, g, or t
  misc_feature (422)..(423): n is a, c, g, or t
  misc_feature (462)..(462): n is a, c, g, or t
  misc_feature (468)..(468): n is a, c, g, or t
  misc_feature (601)..(601): n is a, c, g, or t
  misc_feature (603)..(612): n is a, c, g, or t
  misc_feature (614)..(625): n is a, c, g, or t
  misc_feature (634)..(650): n is a, c, g, or t
  misc_feature (653)..(658): n is a, c, g, or t
  misc_feature (663)..(687): n is a, c, g, or t
  misc_feature (689)..(699): n is a, c, g, or t
  misc_feature (701)..(701): n is a, c, g, or t
  misc_feature (703)..(703): n is a, c, g, or t
  misc_feature (705)..(723): n is a, c, g, or t
  misc_feature (728)..(745): n is a, c, g, or t
  unsure (1)..(748): unsure at all n locations
tattgatngctactgatgtcgcttctcgtggattggatatcccaaatgtagatctggtttgtgcttccccttctctaagctatctccattattttttgttgcaatcaccatgtgcatcatctgttgtgtannnntcatgcggttctccttgttcaggtgatacatttcgaattgccaaattcgtcagagatattcgttcacagatctggccgaactggccgtgctgggaagaagggcactgcaattgtgatgtacaactatgancaaagtagagctgtgcgagtcattgaacgtgacgtaggatgcaagtttacggaggtgggggcttgtggtttgtgttgtacantgctttttttnnnctgttcccactgcattatgttcacttggttttcgtttgccttgcagcttccaaaaattaatgnngagggatccgacttgctgggtggtggatttgactccttngggggnggaggtggtgggtatggtggctcaaactatgggcgctcacgagggggctttggtggacgtggcggtggtggtggttttggccgatcaggcggtggaggatttggcaattctgggtttggccgctcaagtggtngnnnnnnnnnncnnnnnnnnnnnngcgtttgannnnnnnnnnnnnnnnncannnnnnacatnnnnnnnnnnnnnnnnnnnnnnnnnannnnnnnnnnncntnannnnnnnnnnnnnnnnnnngccannnnnnnnnnnnnnnnnnccc

SEQ ID NO: 395 - DNA, 1091 bp, Zea mays
  misc_feature (51)..(51): n is a, c, g, or t
  misc_feature (444)..(444): n is a, c, g, or t
  misc_feature (486)..(486): n is a, c, g, or t
  misc_feature (943)..(943): n is a, c, g, or t
  misc_feature (1040)..(1040): n is a, c, g, or t
  unsure (1)..(1091): unsure at all n locations
aaacagtcgtttcactattttctacaacccccggtatgatcatactttatngtacttggtcttgtttgtgcactgaagtaacatgaccatcctttgtcagggccagcccttctgagtttgtgattccactggctaagtatgtgaaagctgtctaccacacacgtgtgtctgttggaatgcggtttcggatgctttttgagacagaggaatcaagcgtcagacggtgagttgaaacttgtactgtgcatacagcatgaaaactatgaatgccttacggctgcctcttcttccagatacatgggtacgatcacatgcataagtgatctggactcagagcgttggccaaattcacactggcgttctgtgaaggtgaattctttagaactgttgtatgattacaatctacaaaacaattatcaataccatctctagttaaatattaantgttcaattttcaaagccatctgtttattccgttgtatgatntttatgtgtccctttttgggaacatttttgcatcttaatgatggtttctttttctttgggttattgatacgtaggttggttgggatgagtctacagctggtgataaacagccaagagtttcactctgggagattgaaccactgatggcctttccgatgtacccaactgcctttccattaaggctaaagcgtccgtgggcttcagggctacctatgttcaatggtaggctgactgttgaccagaatgcccagtattcatggtaatggttcatttcagtttatattcaaaccaatttctctttgtatgcaggtgggaggagtgatgagttcgctcgttattcttctctcatgtggctccgagatggaaacagaggggctcaatcactgaacttccagggacttggagcatcaccatggcttcaaccaagaatagattatccattattaggtctgaagcnagatacttaccagcagatggctgctgctgcactggaagaaattagagctggggatcatttgaagcagatatcttctctcctgccagtgcaacagccncaaaatttgagtggtggattagatcctttatatggaaatcctgttctgcag

SEQ ID NO: 396 - DNA, 497 bp, Zea mays
  misc_feature (213)..(213): n is a, c, g, or t
  misc_feature (313)..(313): n is a, c, g, or t
  misc_feature (496)..(496): n is a, c, g, or t
  unsure (1)..(497): unsure at all n locations
tggtatgtcctgcaagacataggatcttatttccccattgaatctgaaagatattaaagacagatgcaaatacaatatacagttataagctaaccaactgggataaaactggctgattccctaagacttgagtgaaaagagcttttggtgattaccactgaatggccagcacatgcagaaaacggaactgctccagctgattctgatggttcngcttgtgatttagcttccagctttgaccatgacaaagttttgaagtccaaaacctttaatcagaaaaggattcccgatgttaagatccatggcattgtcngtaagatgaaggtgctggctcagtacaacatctcaattcaagatggttgtgagaatgcctgcccataaatgcagctattaataaatacaacatcttgatgaacaatttacctgaatgtcgccaaggtaacggccattgtggtttccaccaaagacatacatcttctgctgaatcaccacagcnc

SEQ ID NO: 397 - DNA, 493 bp, Zea mays
  misc_feature (294)..(294): n is a, c, g, or t
  misc_feature (382)..(382): n is a, c, g, or t
  misc_feature (384)..(384): n is a, c, g, or t
  misc_feature (386)..(388): n is a, c, g, or t
  unsure (1)..(493): unsure at all n locations
agacacgaacagtgtagttcagtttcctgtgttagaattgttcatcagttgagctcgtctccttagtagctttgtcgacgatgccatcaccagcagtgtcggtgttttcctgtagccatcagaaaggaaaaggtcagggagaactctccactaagaaactgtggtgaccctgcagcaaattaaaccatcatcagcgcatgttaagttctgtcataactcttggtgcatgattcagcacactcaacgatcagggaaaagatagtgtgaaacctttcattgtaaactccaccccanaaccagttacagtatatcatcttgaaaaaggatgaaaagacctgaatttctcaaataacatttgatttcttttattggtgtttataantntnnntttttttatcatataagaaaaggatgggatcctagcattgcagatgttctatatgccagagcatgtttggtccctcgcaacgaagagactgctttgaaccatcca

SEQ ID NO: 398 - DNA, 596 bp, Zea mays
  misc_feature (46)..(46): n is a, c, g, or t
  misc_feature (154)..(154): n is a, c, g, or t
  misc_feature (178)..(178): n is a, c, g, or t
  misc_feature (186)..(186): n is a, c, g, or t
  misc_feature (203)..(203): n is a, c, g, or t
  misc_feature (205)..(208): n is a, c, g, or t
  misc_feature (213)..(217): n is a, c, g, or t
  unsure (1)..(596): unsure at all n locations
ctatttatacgcctcgccccgctccagtctcagcagaaccaccagncctccactccatcttctactccgaccacaaccacagcgaccacgaccgtgcacgtacgtacaggagcacaccaggcaacggcaatggaagcaccacgcccgcgtctcnccatcgtcgccgcgctgtcggcgncgctgctnctcgtcctcgcccacgncnnnngcgcnnnnncctcccccgctggcggcccgacgcccgtcgccgtgcggccctgggtggcgcggctgcaggcactccacgacctgtccgtgtccggcgagcagcagcagggcggcgggttcggggagtgctggggcgccgtgatggggctgagctcgtgctacggcgagatcctgctcttcttcgtcaacggcgagtcgtacatcgggcccgactgctgcgtcgccatccgcggcgccacgcgctactgctggcccgccatgctcgcctccgtcggcttcaccgccgaggaggccgacgtgctgcgcggcttctgcgacggcgaggaggcggaggccacccgcgcgccgccgcctgctgtgcccgctcctcccgcccggggactgggcca

SEQ ID NO: 399 - DNA, 396 bp, Zea mays
  misc_feature (28)..(30): n is a, c, g, or t
  misc_feature (40)..(40): n is a, c, g, or t
  misc_feature (58)..(58): n is a, c, g, or t
  misc_feature (88)..(88): n is a, c, g, or t
  misc_feature (99)..(99): n is a, c, g, or t
  misc_feature (355)..(355): n is a, c, g, or t
  unsure (1)..(396): unsure at all n locations
tacagcagcaagctcagctgatcaggannnatgtctacanaactatgcaatcctacancacatagttaaattgtaattgctttataantctcctaaacnaaaatcaagctccagtccaatggtgaatgaattaccttcaacaaccaagtcaaagaccctctcctcaaaggtcattatcatatcaaacaccccgtcgccggcattgtcctgccaccgctgaggcgccagcttcaccgaggtgttcctcttcagcataggcagcaacccattcctcttgtacctggatggttcgccacagaaatccactgagagcagagcgtttcaagttatcgtgcagggtgcccgacaaggcaangtgagcacacaaagaaacgggaaagcaacgccacaagcatc

SEQ ID NO: 400 - DNA, 1269 bp, Zea mays
gatcttttaggtaatgatgacatactctgaaatgaaggatttgaaccttgaataatgttcttacagtttgttttttatgcagaacttcagagtcttttgtacccatatgtttgccaagatacaatcctatggcctacttgcatgcttatgttcatttttttgacgtgagtgaaatctatacatgtgaataactgtattggtttaccattcttatcagcacgagatacattgcttacaagaataggtacattaggggtttatgtttgtcattaataaaatgaggacaacatagtttttttttatctcagactacttgggtgtcatctcgagcttgtgcagagacattttgcatttcatagtcccatgctaccacgacctttattgttcttgctgaactctagtttagaaattgtcaatactgaatgctgactggtgacagattaggggattttcatcaatacgtccatttcagggtcactcttcatctataccaccaacaaagctagccaatgacacgttgggtctggttctaaatgttcgtgtttttactggtgttcgagggaaattgagtgtggtattggcagtgaggagacgaggctttgaaaaaaaaaatacagggactagggtagataactaaatcaatgtgttgaggatctgaacaagcagtggaccacagataagagcacactgagatgattctcccccttgtttaatgaacatgacattggacaaaaatgtaggagtaactaggaatttgacctcagccattcatatgcacaatctctcttttcttacataataactggtatagaagctaaaagcattgcagcttaaatgtgggtctcttcttgacaggaacatacatatgtgactttgcttactacacgatcagatgctttttatgatctcaaagattccaggtgagctagctaataaatgactaagcatggtttggatgtcacgaggtgtctgaatgtgtgccaccaaaaataaactgacataacttattcttttgtgaacaatgtctagggcccacattcaaaatgctcttttaaagtcaaatgtcctcatcgaagtccaaagatctttacatgagaatgcattgcgtgttgaggatctcccaaccaacccgtcttctcaatctgcatcacaccctccagagtcctctcaagacattagttcacaatctttgtcttctgaaatggcaattggaggaccaggtggactatggcattttatatataaaagcatttacctgacccagtttgt

SEQ ID NO: 401 - DNA, 977 bp, Zea mays
  misc_feature (1)..(1): n is a, c, g, or t
  misc_feature (13)..(19): n is a, c, g, or t
  misc_feature (24)..(28): n is a, c, g, or t
  misc_feature (317)..(317): n is a, c, g, or t
  misc_feature (354)..(354): n is a, c, g, or t
  misc_feature (380)..(380): n is a, c, g, or t
  misc_feature (464)..(465): n is a, c, g, or t
  misc_feature (564)..(564): n is a, c, g, or t
  misc_feature (714)..(714): n is a, c, g, or t
  misc_feature (719)..(719): n is a, c, g, or t
  unsure (1)..(977): unsure at all n locations
natgcctgcagtnnnnnnnagcannnnntcaaaacacaagttcatgactgagtcgatttcaaacaccactgcaacaaatgaacatcttagacacttggctatggaccgtaggtctacaagagatgaatgcatgaatgccatatcaaatcaactaaaaggtagatgtaattactgattataccgtaccgtttgtggtattcagttttcatgatatatttcttttttccaatccacgtgtttggatacttgcatattcttcaacactgtatgtcgcagtgtgattgttagacaattagcagtggtttatgcagattctnaaattacaaaagcgcagtttgaagggttttgttgacntcttagatccgaatgaaatcattacngatgcttctaaaaaaatctaggtttagtttgatgtatatacatacactatatctctgttactgtgaacttaattcttttttccnnaaatttttcctggaatgcgcataatctcgaacttatgtgccttagtaaatcttaatttgatggcagatattgaatcccttgaagctgaaagtgacgcanatggagataagagcctagagacggctcttatgtggtatgataagtttcttggttttcaagttgttggaggagaaggtaatggaaatcttagtgacatggttaattagtatgttaggttgatgcgatagcatgtgacacagtttttttttnttttngttttttgcaaggggtgaaatttgtgttcaacaaaattgatgtgcaaaatcctgacaagaagtattctttttgcataaaacttgctggagaaagatacatctgtgagttacaagtttcttagctgagccatctgatacttgtagtagacgtcacatgattacatttgtgcatcgacgttgaagttccttttcttgtcgataacagtagtctggtgtgttccatctgtggacgatgctgaagaattggtgaaggatctt

SEQ ID NO: 402 - DNA, 622 bp, Zea mays
  misc_feature (5)..(5): n is a, c, g, or t
  misc_feature (47)..(47): n is a, c, g, or t
  misc_feature (84)..(84): n is a, c, g, or t
  misc_feature (194)..(194): n is a, c, g, or t
  misc_feature (230)..(230): n is a, c, g, or t
  misc_feature (249)..(252): n is a, c, g, or t
  misc_feature (261)..(261): n is a, c, g, or t
  misc_feature (279)..(279): n is a, c, g, or t
  misc_feature (332)..(332): n is a, c, g, or t
  misc_feature (436)..(436): n is a, c, g, or t
  misc_feature (492)..(492): n is a, c, g, or t
  misc_feature (513)..(513): n is a, c, g, or t
  misc_feature (556)..(556): n is a, c, g, or t
  misc_feature (566)..(567): n is a, c, g, or t
  misc_feature (617)..(617): n is a, c, g, or t
  misc_feature (619)..(620): n is a, c, g, or t
  unsure (1)..(622): unsure at all n locations
atcgnacctggtgtggtatgttgttggggcaaccatgatttctcttnaccattttgcttgcttattataggttattatctactnctcagatggttcagcctcactctcttctttagaacatctccgcactctctcaggatctccaagaaccatccttagaatgttgattcacaaatgataggaaacatatacgncttttactgaccatatgcttgctgacctattattantttctcctgggtacctccnnnnattgtccanatttgtctgtacatgctnatttaggtggtggttttttttggtgacctctctcactctctttgagcctgacncactccttaaagattgtcatgtagcctataataatatctggtgcctcgcttccggaaatcatatcattgtggtacaactggaatgctcttgttgccgtcttttnttgtttcgtctgggatccacaatctaggtggagtgtaatactcaagatccctgttntgtgaatactggcaaaacaanaaatatatatacctgtctagatgcgggatgccactaatttacnaaaaaaaaannggtggtgattggatgtgatgaacagaaaagctgtgctagtcattctctantnnag

SEQ ID NO: 403 - DNA, 622 bp, Zea mays; identical to SEQ ID NO: 402
  misc_feature (5)..(5): n is a, c, g, or t
  misc_feature (47)..(47): n is a, c, g, or t
  misc_feature (84)..(84): n is a, c, g, or t
  misc_feature (194)..(194): n is a, c, g, or t
  misc_feature (230)..(230): n is a, c, g, or t
  misc_feature (249)..(252): n is a, c, g, or t
  misc_feature (261)..(261): n is a, c, g, or t
  misc_feature (279)..(279): n is a, c, g, or t
  misc_feature (332)..(332): n is a, c, g, or t
  misc_feature (436)..(436): n is a, c, g, or t
  misc_feature (492)..(492): n is a, c, g, or t
  misc_feature (513)..(513): n is a, c, g, or t
  misc_feature (556)..(556): n is a, c, g, or t
  misc_feature (566)..(567): n is a, c, g, or t
  misc_feature (617)..(617): n is a, c, g, or t
  misc_feature (619)..(620): n is a, c, g, or t
  unsure (1)..(622): unsure at all n locations

SEQ ID NO: 404 - DNA, 369 bp, Zea mays
atccaggaatcaaaaggagtagtctctctctctctctctcttctttctacaggagaagcatgaatgggccaacaagagatcagcaaggagacgagctgaaagtaaacagaaactaaaccacatatacctgcagcgtgaggaagggtggcatgtggcggaggtggtggttggtgcctgcctctgtctgcggggaggaagccatagttgtagcaagcctctacctccattaattgcttatcgctggcctgttgagctccactgcactactgtcacggtctcacctagctaactgccccgacaaggatgaggaggagaagggggctgcaattgcaagaacgccaagtgcatgaatgaacgactacacagcac

SEQ ID NO: 405 - DNA, 373 bp, Zea mays
tgggcgccgtggtgcgggccgtgccggatgatcgcgccggtgatcgacgagctggccaaggactacgccggcaagatcacgtgctgcaaggtgaacacggacgacagccccaacgtggcgtccacctacggcatccgcagcatccccaccgtgctcatcttcaagggcggcgagaagaaggagagcgtcatcggcgccgtcccaaagtccacgctcaccaccctcatcgacaagtacatcggtagctcatgagcatgccatgccatgccatgcatgcatgcatcgacgactaaacacatatgtgtatctctagtagcctttgcatacgggatatgatcaattcaagcagccagccgtctgctactgctgtgtt

SEQ ID NO: 406 - DNA, 615 bp, Zea mays
  misc_feature (86)..(86): n is a, c, g, or t
  misc_feature (92)..(92): n is a, c, g, or t
  misc_feature (105)..(105): n is a, c, g, or t
  misc_feature (156)..(156): n is a, c, g, or t
  misc_feature (429)..(430): n is a, c, g, or t
  misc_feature (457)..(459): n is a, c, g, or t
  misc_feature (480)..(482): n is a, c, g, or t
  misc_feature (496)..(498): n is a, c, g, or t
  misc_feature (503)..(503): n is a, c, g, or t
  misc_feature (505)..(505): n is a, c, g, or t
  misc_feature (512)..(515): n is a, c, g, or t
  misc_feature (517)..(527): n is a, c, g, or t
  misc_feature (533)..(535): n is a, c, g, or t
  misc_feature (544)..(554): n is a, c, g, or t
  misc_feature (561)..(565): n is a, c, g, or t
  misc_feature (567)..(574): n is a, c, g, or t
  misc_feature (581)..(584): n is a, c, g, or t
  misc_feature (586)..(595): n is a, c, g, or t
  misc_feature (598)..(614): n is a, c, g, or t
  unsure (1)..(615): unsure at all n locations
aaaaatattgtgcattgcgtgaagtggaatcagaatgggaactgggtactgactgcctcgaaggatcagattattaaggtctgttncttgtncttttgtactttngtctgtttttcttgtcttcaaagaactgatggcagtgtacacgctataacnaaaattctagtgctgtctatggagatgggccaatccatccttgtgagcaaatgatggcagtaaattattaacttttggtacgtttgctaatgctatcactaattcgttttgcagctatatgatattagatccatgaaagagctgcaatccttccgtgggcacaccaaggacgtcactggttagatagctgttccaatatcaagatttttataatttatataccccttcacatattttaagcttcaaaaattgacacaagttttggatgtactnnttcatttgttcattgtaaccatacatnnnatgattgttagaacagtggcnnnaaaatttctagaannntatgntncccacannnntnnnnnnnnnnngtactnnntatgtattnnnnnnnnnnntttttannnnntnnnnnnnncacccannnnannnnnnnnnnttnnnnnnnnnnnnnnnnna

SEQ ID NO: 407 - DNA, 592 bp, Zea mays
  misc_feature (577)..(585): n is a, c, g, or t
  unsure (1)..(592): unsure at all n locations
ctactacgtgtgcgtgttgtaccgttttgtattgagtggtgacttgaaggtggcgctggtgatttgtactaccttctatatatgcatactccttggtacgcaaaataacaaaagtgacgaaagctagcgcagagaaatgcaaatgggcttgggccgtatcggcatactgggccgtgagtttctaataacgcatttgggcttctccgcctggggcctccgcagtccgcacagggacgccgtacatcggccgtgggactcttgcctgactcttggattggattgggcggcacgcggtaactctgtcgtcttgtgttggaagccttttgcccgtcacgactctcggcggccggccgagtcagcacggacggaccaacaaccgaccgaggactacggaacgggtcaaagccaagcctaccacagaagagagtcagagacgcgttgcagcgaatggcacatcgcccaatccgccgtatcttactcgcgatcgcgacctgctaccgtcacaggaatcctacctggactaataaaactgatatacacgtcttgctccgccgcgcccatggacgacgacttgacnnnnnnnnngtgccca

SEQ ID NO: 408 - DNA, 954 bp, Zea mays
  misc_feature (4)..(6): n is a, c, g, or t
  misc_feature (511)..(513): n is a, c, g, or t
  misc_feature (776)..(777): n is a, c, g, or t
  unsure (1)..(954): unsure at all n locations
tgcnnntactgtttggactttcattgactacatgttattgtttaaaacctgaaatgttcatttcccacttgtctctttcttcagtttaaattgttcaatattccatgtctctgccgttgcttgtttcttgtgatgatcccattcggtagttgtggaaggctggaagctaaacgttaaaaagtaactttttgtcactattgtttctaatatgtgaatgattctcctatgcagcaatcaaaatgatgattaataatttaatatcatgtttatgtttaactttaacatcattatctttatggaaaatgtaatagtctatcaaagaattatctgtaacttattttgcatgtcatgctactattgtaggtagtgctgttattaagaaacaatgttttttacttttcctacggttgacgttgatgatgacttgtagagaaatgctgaaaatgagacagagatgaaaggttaattatggaaatatagattgctctgttcctagacggattgttttgtnnnccttgtttatttgagaaacaaaaacaatacaatgagatacaaccatttgttgtgccttgtagagatgcgggttaaggaagcttatgtatcttgtcgaaggtgatccaaatacttcaaaaggatcagcagcaagcataaaaacagcgtatgaacactgcccatttcacctgaatcgatagtattaggcctcgacagtaatacctttttctctttgttatgtgtcttactgttattatccttatgatgaatatgtggtgtgtgtnnatacataaagtatttaagaaagcatatatgtgatctcttagttgtgccatgtgtttattttcagctgctttaccactgagattttcgaaggatttgatgttctgcgtaccaatgggtatactgataccatgagaacatatggttatcttacactctcgataatggattactacagca

SEQ ID NO: 409 - DNA, 510 bp, Zea mays
  misc_feature (1)..(1): n is a, c, g, or t
  misc_feature (480)..(480): n is a, c, g, or t
  misc_feature (482)..(482): n is a, c, g, or t
  misc_feature (495)..(509): n is a, c, g, or t
  unsure (1)..(510): unsure at all n locations
ngctctgttgcggcagtgtccatctgcttgaatgtatcttggacctgtgaccacagttttccagcccgtatctaataaaaagcaaacagaaggttagtgaaacataagcactctgataacatgctattgaattgtcaacaattttgtttcaatgaataagggagcaaattcggtcaggaaaacagcaagagctaacaatactagtttgcagcagccagtggcagacctaggattttacaggagggcatgccatgcattttgataaacttgtttagcgattcagtttcaaggctctcttgggaatgatcttgatcaggttgaaagcatgctctgcaattggttatccaaaaagccagtgagaaagtttcattaccaactgtggtttgtacagcaacaccaacaacgtttgggcaatataagggccttgcactggtaaacctgcccaaacatgttcctcatcaatcttccgtgcccacagcnanctgatacggagtnnnnnnnnnnnnnnnt

SEQ ID NO: 410 - DNA, 686 bp, Zea mays
  misc_feature (252)..(252): n is a, c, g, or t
  misc_feature (389)..(389): n is a, c, g, or t
  misc_feature (485)..(485): n is a, c, g, or t
  misc_feature (570)..(570): n is a, c, g, or t
  misc_feature (644)..(645): n is a, c, g, or t
  misc_feature (650)..(651): n is a, c, g, or t
  misc_feature (657)..(663): n is a, c, g, or t
  misc_feature (668)..(668): n is a, c, g, or t
  misc_feature (670)..(670): n is a, c, g, or t
  misc_feature (673)..(683): n is a, c, g, or t
  unsure (1)..(686): unsure at all n locations
ttcccattcccatcaagcaagcacattctcacttttccagcatcaaggcatggagtatggcaacggatgacaccttgctggataatttccacacataccttaacatcaccaaacagcacttgccatgaactgtgagggggattgcaaaggaagtctcctacaatgataacctgcattacattttcataagtccccaaccattgtagttctcggcacaggtttgtccaaactgataagttcttttttgtttcnttgggttctctggactcaggcttcaagctttcagatcaaaatacttaagtattactcctcaattctgatttctaaaagtaacttgattttagattttgccactcgtatatatatgcaggtcattataggattctagnaacccgtcccccattttttcttcttatgcccatgctaaacaatctactaatcacagttaaaggtcatttgaatcatttcaacacttcattaatttntatgcacaagcctaaaacaacttacatttggcatcagagtatgtaagtaccacatgaagatatgttttgttcaatattatgccantagaaaagaagaaagaagaatgcatgttgcagtaatttaatcaagcctagtaactcgtactcatatcatacctnngtacnntcatannnnnnngctgntnctnnnnnnnnnnnatg

SEQ ID NO: 411 - DNA, 553 bp, Zea mays
  misc_feature (318)..(318): n is a, c, g, or t
  misc_feature (325)..(325): n is a, c, g, or t
  misc_feature (430)..(430): n is a, c, g, or t
  misc_feature (504)..(504): n is a, c, g, or t
  misc_feature (519)..(519): n is a, c, g, or t
  unsure (1)..(553): unsure at all n locations
gaccctgagaatgtggtaagtagtgtcatggaagtattgcttaatgacaagtttaagcaatggttgtcatccaaatgtgaacagaatattgatggagaccatttgcttcctaagcaataccgcaatattatacatacggttgcagccttgggatatgatttggctttgaagccactgcttagttcaggagtgcctataaactaccgtgatgcaaatggatggactgctctacattgggctgcaaggtttggcaggtatacaaaactcttcacatcatatgcagcataatgctattttttcatgttcaagtttcaagtngatcttngacacaattttttttttctatttaccattccttgtattcattgccaggagccttcttatttttagacctagacacaaaattttacttgcacaatttaggcagttnatctcttatgtaatggactaatggttttctctaagctgtttttcttactgacttcatcgtagtattttctattnaaaaaacagagaagntatggtggtggctcttcttactgctggtgctgca

SEQ ID NO: 412 - DNA, 520 bp, Zea mays
  misc_feature (203)..(204): n is a, c, g, or t
  misc_feature (249)..(268): n is a, c, g, or t
  misc_feature (335)..(336): n is a, c, g, or t
  misc_feature (379)..(382): n is a, c, g, or t
  unsure (1)..(520): unsure at all n locations
atggatccatcttgtgaaagcatgcatcatcggagacgaggccccctaataataataataataacaacaactgatgacgagtggcacaggtcgagggcatgcgtgttgtcaaagccacaggaggactctgcaaaagggtgcagtgcagggcgcgcgtttactctgctcggaggctcggagcttcgtccaggccaggacgctgnnggacgaccggccaggccagcacaggaccacgccatgcacgctctnnnnnnnnnnnnnnnnnnnnagagctacagttatgaccgtacgtaccgcaacgcagcacaggcagccgcgtctgaatcgtcgggggnnggcctgcgtaatcggctttattatccagtgattgcttgcttgnnnngagacgatggaagaagatgcatgcagcgcgacgacatgcgcagtgcatgtaatggagtttaatgcaaatctcgtctcgtggtggggctttttaagaagataaataatagacgagttacttctagtactgccaccatgc

SEQ ID NO: 413 - DNA, 459 bp, Zea mays
  misc_feature (52)..(52): n is a, c, g, or t
  misc_feature (117)..(117): n is a, c, g, or t
  misc_feature (128)..(128): n is a, c, g, or t
  misc_feature (289)..(289): n is a, c, g, or t
  misc_feature (307)..(307): n is a, c, g, or t
  unsure (1)..(459): unsure at all n locations
caaggacccaaggctggctgcgagcgccgagcagacgagcagtcactgatgngggggtggggctctgggtcacagtcacagttactcctcctcgtcctcctccagcggtcctgctcntcaccatctanacgaccggtccacgacagcggccacagcgctgcctcctgcagcggaacaagaaccaatggcgcccgtgtccaattacagtttaggacacaggaatcacgccatcacctcgcctctgcgccttgtctcgatggaccgaccgtacggtgatcccgaccgtaantttttttttaccctgcgntcagacgctcgcgccgtggctttaccgcaatgttttttaatctctttgtctgtttgtctctgcggcagttaccctaccctacccgataggtctagctgtactggtactgcttgctacggctacagatacggagcaacaggcaacgaccgcat

SEQ ID NO: 414 - DNA, 553 bp, Zea mays
ctggcgtcatgtctcccgtgcgcacacgctgacatttcctgcatgggcacccgaggccgagtggcgagtgtactcgaaccatgtgttgtgtcgaagtcgaaccaaatgcaagccgtggtgtacataacatgcttcaccgtgaacagatcgctcaagcaaaactgaggaatctcaggcccaacaaaagatgggagagactcggtctttaactctgtagggtatggtcaaattgctcctttcgtaaaccaaccacagcagtagacaggcttcggtatcaggagtcccagagtgagggtgcagtaggcttttcatacagatcagaggagtcgagagtgagggcctggtggaagccacctggcccacatgacatcatcaggtcatcacaagaaaagtccttcgcgttttttttttcctttcagctacatatatatgattaaacctgaccacaggaaatgtgccggttcaggtcaggcaccttatcgtgtcgtctttagtttcagttgttgggcatggagggttcatttcacctcagaaacaaatgcctcaaacacca

SEQ ID NO: 415 - DNA, 562 bp, Zea mays
  misc_feature (1)..(7): n is a, c, g, or t
  misc_feature (16)..(16): n is a, c, g, or t
  misc_feature (557)..(557): n is a, c, g, or t
  unsure (1)..(562): unsure at all n locations
nnnnnnnagctcgtanggcaggagttccaaaacgggcacgcaaagagaagcaactcagtacttgtagtccttgacgtggaggctctcggtgtcggcggcagcatcacccttgtaggtgccgagggtagcctcagagttggccttgcacctggcgaggaaggcagctctagccttctccaagttctccaccttgccagcccaggccttgagggtgctcgcctggagggcacggccgaaggagaaagacagggaccacggcttcttggtgctgagcttgttcatggcattgaggttgcgggtggcctcctcctcgctctgtccaccagagaggaagacaacagcaggcacagcagcagggacggtcctctggagggtacggacggtgtactcagcaatcacctcaggggtcaccttcttggagtcggagcctggagtcaccatgttgggcttcaggagggtaccctccaggaggacatggtgctcgttgagcgccttgtagcaggcagcaaggacggtctcagtgacgtaagcgcagcgatcaatgtcatgagggccancaaca

SEQ ID NO: 416 - DNA, 379 bp, Zea mays
  misc_feature (7)..(7): n is a, c, g, or t
  misc_feature (328)..(328): n is a, c, g, or t
  misc_feature (377)..(377): n is a, c, g, or t
  unsure (1)..(379): unsure at all n locations
caccccnggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgntgcgccaagtactacgaggcaggtgcccgctttgccaagtggcgcgctntt

SEQ ID NO: 417 - DNA, 1214 bp, Zea mays
  misc_feature (8)..(12): n is a, c, g, or t
  misc_feature (42)..(44): n is a, c, g, or t
  misc_feature (291)..(291): n is a, c, g, or t
  misc_feature (296)..(296): n is a, c, g, or t
  misc_feature (350)..(350): n is a, c, g, or t
  misc_feature (375)..(375): n is a, c, g, or t
  misc_feature (408)..(408): n is a, c, g, or t
  misc_feature (415)..(415): n is a, c, g, or t
  misc_feature (453)..(454): n is a, c, g, or t
  misc_feature (456)..(457): n is a, c, g, or t
  misc_feature (602)..(602): n is a, c, g, or t
  misc_feature (700)..(700): n is a, c, g, or t
  misc_feature (784)..(784): n is a, c, g, or t
  misc_feature (879)..(879): n is a, c, g, or t
  misc_feature (894)..(894): n is a, c, g, or t
  misc_feature (1002)..(1002): n is a, c, g, or t
  misc_feature (1083)..(1083): n is a, c, g, or t
  misc_feature (1119)..(1119): n is a, c, g, or t
  unsure (1)..(1214): unsure at all n locations
cgcgtcgnnnnncgatcatgtcggcctactgcggaaagtacnnnggtacgtcccatcgtctcctcctccccccctgtcgtgatcgtatcctcgttcgttgctgatcttcgttgctgatctgcttgtgatgcctttaggtctcgtgtatcgtagatctgtttagttgtttcgttgttggtgcgctcagatctcgctgtgattgatgggtatgctaaggctaacggctatatggacgggagaacactctttgtagactgtactgtccacagatcggagtttgaaatggaatgngtggncagaaatctggtggcctagcctaacgattcgtataggtctgagagactcgttcngttgtaggatttgtggatttttttnagatccgtacaggattgtgctgtcgtgtgcccnccagggncttggtggttgccaaaaggtgatgcctctgatcggttnntnnggatatgggatttgcttactttttgcttcgattttatacatacatatagtggtatgcatctgctcgtcctgtttccagttgatgaaacatattctcctgctagcaagttttatacaaaaatagagggactagtttttatatggtngtttcaaattatatatagcctgtttgttcaatctaaatatatttgcctgttgtttcatggctactagaatagatgctggacgcatatacatctagganagtcagatatgtaaatcgtttaaagctttgtgctagtctaatcttgatctgtggttccttttagtcatgatgtttatgccgatncaattatatataaagcagtttttggttaataaacagtaaacttcctgaattaataattaaagtttattttgtattattcaggatggcctcctganttgataatggaagtnattttgtattattcagtatagccttggtacctggtagatagccatgcttattatgcatattgttttgcagatgagctcatcaagaatgctgcctacattggcaccccnggcaagggtatccttgctgctgatgagtccactggcaccattggcaagcgcctttccagcatcaatgtcgagaacgttgangagaaccgccgtgccctccgtgagctcctattctgntgccctggtgctctccagtacatcagcggtgtgatcctcttcgaggagaccctgtaccagaagaccaaggatggcaagccttttgttgatgtcct

SEQ ID NO: 418 - DNA, 362 bp, Zea mays
  misc_feature (91)..(91): n is a, c, g, or t
  misc_feature (295)..(295): n is a, c, g, or t
  unsure (1)..(362): unsure at all n locations
gtccactggcaccattggcaagcgcctttccagcatcaatgtcgagaacgttgaggagaaccgccgtgccctccgtgagctcctattctgntgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgntgcgccaagtactacgaggcaggtgcccgctttgccaagtggcgcgctgttctcaagattggcccta

SEQ ID NO: 419 - DNA, 718 bp, Zea mays
  misc_feature (16)..(17): n is a, c, g, or t
  misc_feature (60)..(60): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (129)..(132): n is a, c, g, or t
  misc_feature (195)..(195): n is a, c, g, or t
  misc_feature (197)..(197): n is a, c, g, or t
  misc_feature (231)..(231): n is a, c, g, or t
  misc_feature (324)..(324): n is a, c, g, or t
  misc_feature (372)..(372): n is a, c, g, or t
  misc_feature (557)..(558): n is a, c, g, or t
  misc_feature (629)..(629): n is a, c, g, or t
  misc_feature (636)..(638): n is a, c, g, or t
  misc_feature (645)..(645): n is a, c, g, or t
  misc_feature (647)..(651): n is a, c, g, or t
  misc_feature (658)..(660): n is a, c, g, or t
  misc_feature (662)..(667): n is a, c, g, or t
  misc_feature (675)..(679): n is a, c, g, or t
  misc_feature (695)..(695): n is a, c, g, or t
  misc_feature (699)..(703): n is a, c, g, or t
  misc_feature (705)..(714): n is a, c, g, or t
  unsure (1)..(718): unsure at all n locations
ccggagccggagccgnngccggcgccgacaatcgttccaactgatatggctacgacgccnccaggattcacgggcaacctgaaggtgagttattgaaagatccncntccgccancgcacggttcaggcnnnnctttgccagttccggcgcactgctaggacggcatcgacacatcaacaccacccatggctaccntncctatccccaagcgtcgtcgcaggtccctgcccnggcgcgttgcgtctccatcccagggcttccgccactcgagaaactctttgctactgcgcccccatccgctcccttcaatcgggggcatgaatnatttgccgccgagctgtgctgatccgggggcccgacgtctgtggcacntcagtcctcctatttgcgcttagtagtaggttcagttctctgcagacaatagctgaaacactactgtacatggatcttgggttaatttgactgcgaatgttatgattttattcggcatcagttgattggattgattgtagcttgaacctttgatcctgattatccaccattttatctcccctggnngtgaataaactgttggcatttttatctctcataggagactaatcacgattaatcgattaatcgtaactacnaagctgnnnaggagtnannnnntatcagnnngnnnnnnaatctgannnnntgattaatcgacgatnaatnnnnntnnnnnnnnnnatta

SEQ ID NO: 420 - DNA, 919 bp, Zea mays
  misc_feature (78)..(80): n is a, c, g, or t
  misc_feature (92)..(97): n is a, c, g, or t
  misc_feature (99)..(99): n is a, c, g, or t
  misc_feature (111)..(112): n is a, c, g, or t
  misc_feature (121)..(123): n is a, c, g, or t
  misc_feature (128)..(128): n is a, c, g, or t
  misc_feature (132)..(132): n is a, c, g, or t
  misc_feature (135)..(144): n is a, c, g, or t
  misc_feature (146)..(146): n is a, c, g, or t
  misc_feature (148)..(148): n is a, c, g, or t
  misc_feature (150)..(153): n is a, c, g, or t
  misc_feature (155)..(155): n is a, c, g, or t
  misc_feature (200)..(200): n is a, c, g, or t
  misc_feature (416)..(416): n is a, c, g, or t
  misc_feature (459)..(459): n is a, c, g, or t
  misc_feature (467)..(468): n is a, c, g, or t
  misc_feature (470)..(476): n is a, c, g, or t
  misc_feature (480)..(482): n is a, c, g, or t
  misc_feature (484)..(484): n is a, c, g, or t
  misc_feature (486)..(486): n is a, c, g, or t
  misc_feature (488)..(488): n is a, c, g, or t
  misc_feature (490)..(490): n is a, c, g, or t
  misc_feature (492)..(493): n is a, c, g, or t
  misc_feature (495)..(497): n is a, c, g, or t
  misc_feature (499)..(501): n is a, c, g, or t
  misc_feature (503)..(507): n is a, c, g, or t
  misc_feature (509)..(509): n is a, c, g, or t
  misc_feature (511)..(511): n is a, c, g, or t
  misc_feature (513)..(513): n is a, c, g, or t
  misc_feature (518)..(518): n is a, c, g, or t
  misc_feature (552)..(552): n is a, c, g, or t
  misc_feature (898)..(902): n is a, c, g, or t
  misc_feature (905)..(918): n is a, c, g, or t
  unsure (1)..(919): unsure at all n locations
accagcccaaaatcccagttctggtcttgcagcatcagaacgaataacaaggtgaagtatttttttttccatgtagtnnnatagatatagtnnnnnntncatactgagacnnaacgcgaannnctggntacnttnnnnnnnnnnantntnnnnanagataaaactgagcagtctcagatgggaaatcgtacagatattcnttaaacagctagccatacaaacctgcatggaaagatgcgaggactgtgctcgaggtagaatggcacgatgtccttggcctcatagcatggttgcttggcattgctcagcgacggagctgccagcattgcagcaataagaccacctgtgcttgtgccagcgatgacatcaaagtagttagctatgcgcgcgctgctcccatcaagctcctaaaaaantgtaaaagaacaccaacgaataaatggcactcaaacttgcatntatatatnnannnnnnntcannnancnanananntnnngnnntnnnnngnantntagtntttttgcagttttgaaataatactatggtatttnatgatactatagtattaaagctcaaaaggtgtttgctttgtacagtcaaaactcagttttaaatatcatggtttatccaaaactgtggtatttttggagttttcgaaactctacttaagacctcatttttcttttcttctctctacatatactttgtttttccaatagaaccaaacatatctcgattttgagcaatactgtagttttactgtggtaaagcaatatcgtagtatttatgtcatgtacaattgtaaactatggtatctcaaaactacagtatttcaaaactgcattccaaaacagaccctaaaatttcaacttccagtgtccggtatttggcatgcannnnnacnnnnnnnnnnnnnng

SEQ ID NO: 421 - DNA, 748 bp, Zea mays
  misc_feature (42)..(45): n is a, c, g, or t
  misc_feature (64)..(64): n is a, c, g, or t
  misc_feature (91)..(91): n is a, c, g, or t
  misc_feature (119)..(119): n is a, c, g, or t
  misc_feature (132)..(132): n is a, c, g, or t
  misc_feature (272)..(272): n is a, c, g, or t
  misc_feature (295)..(295): n is a, c, g, or t
  misc_feature (350)..(350): n is a, c, g, or t
  misc_feature (522)..(522): n is a, c, g, or t
  misc_feature (536)..(536): n is a, c, g, or t
  misc_feature (614)..(615): n is a, c, g, or t
  misc_feature (635)..(642): n is a, c, g, or t
  misc_feature (647)..(647): n is a, c, g, or t
  misc_feature (649)..(651): n is a, c, g, or t
  misc_feature (654)..(656): n is a, c, g, or t
  misc_feature (666)..(667): n is a, c, g, or t
  misc_feature (673)..(679): n is a, c, g, or t
  misc_feature (685)..(693): n is a, c, g, or t
  misc_feature (706)..(706): n is a, c, g, or t
  misc_feature (711)..(711): n is a, c, g, or t
  misc_feature (715)..(723): n is a, c, g, or t
  misc_feature (726)..(730): n is a, c, g, or t
  misc_feature (732)..(742): n is a, c, g, or t
  misc_feature (744)..(744): n is a, c, g, or t
  unsure (1)..(748): unsure at all n locations
cataatgcaacaaacgttaaaaaactacagagatggaaaaannnncagtcaccataaaagatgncttgtacaacaagttcatgcaaaaaanttattattactattaatgagctaactanaaacaaacacccnaaatataacatcatgacatcaaaaggaagacatgtaccttgagggcaccaaagacacggttcccagtcgtagtcctaataaggccaacatccaagagagcacggaaaggcctcctctcatcagctggctcaacagagaantcctcaccagtggcctgatgaangaaaagaaacaatataaatgcccaaccaatgtgacatcagcaaaaaataagatcnaaatttagccaaattttacctcaacattgccctcatattccttatctaaaccacgggtcttgagcacacggcgagccaacagaaggccagtgcagtaggctacaagatgagtgtaagcagttgaactagtgaatatataaattcattaaggtacaatatgcaatttacacantatttccagaaggnaaattaccagctgcatagttggtcagaccaacttcaagaccatatcgtggcaactcatgcgagtaagcagaagcaagnnccatatcacctgctatactnnnnnnnntgatntnnnctnnnatgtccttgnnggtctnnnnnnntctagnnnnnnnnnacaatattatgcnactgnagcnnnnnnnnnatnnnnntnnnnnnnnnnnanatga

SEQ ID NO: 422 - DNA, 714 bp, Zea mays
  misc_feature (35)..(41): n is a, c, g, or t
  misc_feature (279)..(279): n is a, c, g, or t
  misc_feature (651)..(652): n is a, c, g, or t
  misc_feature (668)..(669): n is a, c, g, or t
  misc_feature (673)..(673): n is a, c, g, or t
  misc_feature (693)..(693): n is a, c, g, or t
  misc_feature (695)..(696): n is a, c, g, or t
  misc_feature (702)..(709): n is a, c, g, or t
  unsure (1)..(714): unsure at all n locations
ctcagcagttttaagtttctctatagttcacactnnnnnnnacaaatccggctgtgcccaaacaactctattcaacagagaagcatcgaaactagcatggagcaaaatctgaattccttaaatctccaacctaaaacacttagccgaccaaaaagcccctgcttcccaaacgattcgccaagttcgttaaagattttgggggaaaacgaggcctaaacaacgggaagtaagggaaatcaatagaaaaaacatggttttggtgagaacctgtgcctagcngcgctctggggaagattggctgagggagctgcgttttgggggagtgcaagaggagcacggtatccagggaagatgtgcgggagagagatatatattggatacagctcaagaggggaggaacgctcctccttaattgttcaaggcaacgctcctgccttcttccaaaaaaaagaggggaggatcctgacaaaattccagcaaagataggtgtgagagtttattgctgccttccttttctgcttgccttttttatctcctcaaaagagttgtgtttgtgttctatcccccgtaaaacacaatttggaaagtgtttctcaaaaattctgatgcatgcattgactctcttttttttgtcactatcctggatttctnngtattcttatttccanngtantgataactaaaaaaatgaancnntagttnnnnnnnntatat

SEQ ID NO: 423 - DNA, 475 bp, Zea mays
  misc_feature (161)..(161): n is a, c, g, or t
  misc_feature (305)..(305): n is a, c, g, or t
  unsure (1)..(475): unsure at all n locations
tcagagtaactgaaaagcctatatcagaaaatatgcccccactaaatgcattatcagcaacatcaattatcacagaattaggcaatccccacaagccagcaggaatactcccactgaattgattttgacttattctgaacctctgaagtgtcttgcaagangagtaagaagcggggaattcacctgaaaagttgttggtcaaagccaataagaactggagcttgttgttttggcacaagaatcttggaaattcgccagaaaagtaattctcggatatgtcgattgtgttgagtggtgagaatcgncccaggttggcagggaactttcctgagaactgattttcataggttgagaatgactcaagaaactgcaggttccccaactcttcaggaagttcaccaaagaagttgttgtggtatatatggaatatcctcagcttcttcaggctgccaatctccttaggcagcatgccagt

SEQ ID NO: 424 - DNA, 754 bp, Zea mays
tgcatgcagttgcagccgtgtttgccgtttagcaacttcaactcgtcgtcgtacaactacggacagacgtgtacgcgcttgttgcgttcgtccacgacaagggcatgaagggcgcgctcgacgatttgaaagtgatgctcacgaggaacgagcccatcaccggcctcgccaaggtggtggcggtcctcgtgatcttcgcgctcggcgtcgtcgccggcctgtgggtgtctgccggggtccgccggtcccagcaggaaagcgtcgacccgaggagcaccgggttccatggcggcggcggcggcggcatctgctgccggcccgagcccaaccccgacttcgaagagttcgtggccccgacgcgcctcatgcacgacatgacggacagggagctgttctggcgcgccacgctggtgccggcggccgccgccaggtacccgttcgagcgcgtgcccaaggtggccttcatgttcctggccggccgcggcgtcctgccgctggcgccgctgtgggagcgcttcttccgaggggctgggcacgaggagcgcttctccgtctacgtccacgcgccgcccggggtggcgatcaacgtgtccgaggactcgccgttctacggcaggcagatccccagccaggttagtgattgtcgtctcgtcgcacatatgctgcatgcatgatgagtactacttgctctgtcaacgtgtccgaggtcgactctcgcttcgtctgatctgatcaggggtaccgagctcgaata

SEQ ID NO: 425 - DNA, 609 bp, Zea mays
  misc_feature (475)..(475): n is a, c, g, or t
  misc_feature (528)..(528): n is a, c, g, or t
  misc_feature (531)..(534): n is a, c, g, or t
  misc_feature (546)..(551): n is a, c, g, or t
  misc_feature (553)..(553): n is a, c, g, or t
  misc_feature (555)..(559): n is a, c, g, or t
  misc_feature (565)..(567): n is a, c, g, or t
  misc_feature (569)..(569): n is a, c, g, or t
  misc_feature (574)..(581): n is a, c, g, or t
  misc_feature (589)..(595): n is a, c, g, or t
  misc_feature (601)..(602): n is a, c, g, or t
  misc_feature (604)..(608): n is a, c, g, or t
  unsure (1)..(609): unsure at all n locations
taatactcagcatggttgcggggacagtgccgataccatttgggagaggtcagtcgacttctctttatgccgatgtggtgatgttgattgtattgaggtctgtgatatcagggagtggctgccaaaatcaaaaatggaccataagctgtggaagcttgttcttttgctaggagaatcttatttggcacttggagaggcatacaagaatgatgggcagcttcagcgcacccttaaagttgttgaattagcttgtttggtatatgggtctatgcctggacatattgatggcgacgagttcatctcatccatgtccaacagttcattgagtcgagaagatcttgccctaaaaactaaacttgtactggacgaggcagactattgcaataacaaaagatgcttcagttatgaagtttcttcccaccaattgccaccaaattatttgttctgggcaaaggcatggatgcttgttggtgangtctatgcagaatatcacagattgaatagtcatcaagcaaagttggcaccagnacnnnngtctcatggcgnnnnnngnannnnnaatgannntncattnnnnnnnnaacgcctnnnnnnnaaactnngnnnnna

SEQ ID NO: 426 - DNA, 443 bp, Zea mays
  misc_feature (33)..(33): n is a, c, g, or t
  misc_feature (49)..(49): n is a, c, g, or t
  misc_feature (199)..(199): n is a, c, g, or t
  unsure (1)..(443): unsure at all n locations
actataatctacaatgaatagcaagcaatcggntattagcttctatacnattgactaccatcaatcctttgtaagtgcccctgacaactctttgtacccttgacagtgtcctactactgtagtgccattttttggagaccagttcttctggggcgagagagttcatgcacgaggagtgggtcctgcacctatatctatngcagaacttactgtagaagcactatcagatgcaataatattcatgcttgatccagaggtagtactatttcttatgctttcactatatgcatctggtcatgccaacaatgtttttgatgcagaactctgctttggtaaggccccattgtgctaataactaatccatttatgatcctttgctgaaggtaaaatcacgaacaatggaactggcgatagcaataggcaatgaggatggtgtggcagca

SEQ ID NO: 427 - DNA, 788 bp, Zea mays
  misc_feature (721)..(721): n is a, c, g, or t
  misc_feature (736)..(741): n is a, c, g, or t
  misc_feature (746)..(757): n is a, c, g, or t
  misc_feature (768)..(773): n is a, c, g, or t
  unsure (1)..(788): unsure at all n locations
gtttgcttcgcagctgtttgtaggacatggagagaaatgtgtaaagagattgtgttgagcccggagttttgtggcaagctcaccttccctgtgtctctaaaacaggtaagggaaagaacaatcaacctccttcagttcgagcaatcttgaaccggatgttgagaattgcctccaaaccttgagcagcggatatctatatctccctctggtccttgatatattgcttgtttcttttgacagcctggtcctcgagatggaaatacaatggtccagtgttttataaagaggaataagtcaaaatccacttaccatctctacctgtgccttagcaatggtacgtcacatgatttgcacattttcaagattcaatagcaatgttcataagtttatactgttttattggagcatatgggattattgttagccagatatgtttctcctttttgagtgtttgattttgtgattatatctcgtatcttgtaatcctcataaattctgaaattgtgtggccttttaatctcatattcatgagagtatttacagttaaatgatcaatggtctgtttatcttgtttcactttatcaaatttgttgactcattttcttctgtgcacagttgttacttcagaaagtgggaaattcctcttatcagctaaacgacaccgcaaaaccacatgcaccgagtacactatatcaatggattctggcaacatctcaagatngaaaagaacctacannnnnnaaatnnnnnnnnnnnnatgtttttgannnnnntgttcttgtttcccc

SEQ ID NO: 428 - DNA, 395 bp, Zea mays
  misc_feature (218)..(218): n is a, c, g, or t
  unsure (1)..(395): unsure at all n locations
cgccacagattccatcaagaacaccgtacgttccagtgttccaacagtctctctttcgcttcctccttccgccgccgccccaaagcggctctggcggcttcttggctactgatttggttcggcttcgcttgtgcaggtgtatgtcaaggcgaaagagtgcacggaagtggtgtccatggaggaattcgccgtgattcttggaaggcatttcacctcgntgtaccctcaggtatctcgaaactaattgatgtatccgggtttgctgctgagggatcaagatgggatttttatggatctctcttcgtgctgccgtttcggggcaggtttcggaggccacggtgactatcgtggagcgccacatgggagcgtgtgactgtcgacggaaagcctcattc

SEQ ID NO: 429 - DNA, 679 bp, Zea mays
  misc_feature (47)..(47): n is a, c, g, or t
  misc_feature (183)..(183): n is a, c, g, or t
  misc_feature (208)..(208): n is a, c, g, or t
  misc_feature (318)..(318): n is a, c, g, or t
  misc_feature (338)..(338): n is a, c, g, or t
  misc_feature (391)..(391): n is a, c, g, or t
  misc_feature (397)..(397): n is a, c, g, or t
  misc_feature (414)..(414): n is a, c, g, or t
  misc_feature (612)..(612): n is a, c, g, or t
  misc_feature (634)..(635): n is a, c, g, or t
  misc_feature (638)..(644): n is a, c, g, or t
  misc_feature (646)..(646): n is a, c, g, or t
  misc_feature (648)..(649): n is a, c, g, or t
  misc_feature (653)..(654): n is a, c, g, or t
  misc_feature (660)..(669): n is a, c, g, or t
  misc_feature (671)..(676): n is a, c, g, or t
  unsure (1)..(679): unsure at all n locations
ggaacacgaacaaacacatatatgaaaaggtgagatgtcgcatcagngttgttccttgtcttgctatgctgcacatgagcacattggcgcttccaatatcttgaatgacagggcattctcggatcatgcagttgcatctattctagtgctgttcttctgtcttttcccagttatattctagtntggacaattgctgaaagttcccagntgctgcttaagcttaatctaatgaattcttgtttttatcaaagtttggagtttagatagtgtagcatttattttcatactgatggtgtattgtccttatcatttcttttnaatcttcagccaaacctaangcaacaagaaatctgatattattaagaataagcagcctctatcctgaaagagngggggnaaaaggaagggtgacantatcatctgtgatcgtgtttgttgcaaatcttcttcatatgcacctttataatctaaatatactgcgctcctagcgactttgttcattgcaaggctttgtgtgaaatcattgctccaatcatgaatctaggaaatatactttaagctctaaaataagtgcatttatagaatgttttggagacatcaatgctactatanaattacatatatacactcctanngtnnnnnnntntnntaanngcactnnnnnnnnnnannnnnncaa

SEQ ID NO: 430 - DNA, 374 bp, Zea mays
  misc_feature (63)..(65): n is a, c, g, or t
  misc_feature (129)..(132): n is a, c, g, or t
  misc_feature (139)..(140): n is a, c, g, or t
  misc_feature (242)..(242): n is a, c, g, or t
  misc_feature (265)..(265): n is a, c, g, or t
  misc_feature (267)..(267): n is a, c, g, or t
  misc_feature (287)..(288): n is a, c, g, or t
  misc_feature (317)..(318): n is a, c, g, or t
  misc_feature (333)..(338): n is a, c, g, or t
  misc_feature (352)..(356): n is a, c, g, or t
  misc_feature (371)..(373): n is a, c, g, or t
  unsure (1)..(374): unsure at all n locations
tagggtgctccgtgggcggctacccagcatggagctgcctcaaatacattcccaacaggtcgnnncactaccaccaccgtctcagtagaaaaaacaaaacgcagcaggtgtggtatcgatcagctcgtnnnnatatatnnatgttctgaatgggtgggctctcggtctcgtcgcaggctggccggagtggccctggccgcgccggcggtgaactactggtggccgctgcctgctaacgtgtngagggccgcgtacgggaggctcnangcccgggaccgtaggacctnntggatcgcgcaccacgcgccggcgctgcnncacgcctggctcgcnnnnnngtggttccgggtgnnnnngatcgtcagggccgnnng

SEQ ID NO: 431 - DNA, 720 bp, Zea mays
  misc_feature (76)..(76): n is a, c, g, or t
  misc_feature (135)..(135): n is a, c, g, or t
  misc_feature (242)..(242): n is a, c, g, or t
  misc_feature (255)..(255): n is a, c, g, or t
  misc_feature (262)..(262): n is a, c, g, or t
  misc_feature (290)..(290): n is a, c, g, or t
  misc_feature (317)..(317): n is a, c, g, or t
  misc_feature (323)..(323): n is a, c, g, or t
  misc_feature (325)..(325): n is a, c, g, or t
  misc_feature (346)..(346): n is a, c, g, or t
  misc_feature (374)..(374): n is a, c, g, or t
  misc_feature (377)..(377): n is a, c, g, or t
  misc_feature (402)..(402): n is a, c, g, or t
  misc_feature (407)..(407): n is a, c, g, or t
  misc_feature (417)..(420): n is a, c, g, or t
  misc_feature (424)..(428): n is a, c, g, or t
  misc_feature (443)..(443): n is a, c, g, or t
  misc_feature (448)..(450): n is a, c, g, or t
  misc_feature (455)..(455): n is a, c, g, or t
  misc_feature (467)..(467): n is a, c, g, or t
  misc_feature (476)..(476): n is a, c, g, or t
  misc_feature (498)..(498): n is a, c, g, or t
  misc_feature (519)..(519): n is a, c, g, or t
  misc_feature (535)..(536): n is a, c, g, or t
  misc_feature (552)..(553): n is a, c, g, or t
  misc_feature (588)..(589): n is a, c, g, or t
  misc_feature (595)..(595): n is a, c, g, or t
  misc_feature (611)..(612): n is a, c, g, or t
  misc_feature (638)..(638): n is a, c, g, or t
  misc_feature (643)..(643): n is a, c, g, or t
  misc_feature (652)..(652): n is a, c, g, or t
  misc_feature (662)..(666): n is a, c, g, or t
  misc_feature (671)..(676): n is a, c, g, or t
  misc_feature (683)..(683): n is a, c, g, or t
  misc_feature (685)..(692): n is a, c, g, or t
  misc_feature (695)..(715): n is a, c, g, or t
  unsure (1)..(720): unsure at all n locations
atgaggataactggagcgactgagaaaccctggagccgggaggagtgtgtcttgtatctactcacatcgatgttantgatgttaacaaataacatgtcgaggttgttaggtcttgttagcagcccctaaatgatnatattgtcttggtgtattttcaaaaatatgtacattaccatgtgaaaatttgacagatcattgaataatttgtagatttatctcaggaggatagagggatgtttgangttcgccaaaatnttgtttngccctggagccttgttttcttcactgtntattaatgctttacccaaaaataagantttttntnagcaaataggaagaagtgtanctttaagggctagtttgggagctaaaanagngaagggaattagagggctaaaatcntcttnttcaaaattnnnnaagnnnnngattttagccacttnaatcnnntctgnttttgtggcttncaaattagncctaagtaatgtttgtttttancttgtgaaaagtgctacagcnactgaaaggcagagannaccaaactgtctcttnnaaaagcacctgttttcgcgttgcttttggcttctnnaaatgngtgaaaataggggggnncgtatatttgtttcgagagagatggntgagntttatagtnattttgaccnnnnnaaatnnnnnnaattttnannnnnnnngannnnnnnnnnnnnnnnnnnnnggggg

SEQ ID NO: 432 - DNA, 1200 bp, Zea mays
  misc_feature (1)..(12): n is a, c, g, or t
  misc_feature (18)..(30): n is a, c, g, or t
  misc_feature (56)..(56): n is a, c, g, or t
  misc_feature (93)..(93): n is a, c, g, or t
  misc_feature (218)..(218): n is a, c, g, or t
  misc_feature (308)..(308): n is a, c, g, or t
  misc_feature (378)..(379): n is a, c, g, or t
  misc_feature (441)..(441): n is a, c, g, or t
  misc_feature (443)..(443): n is a, c, g, or t
  misc_feature (592)..(592): n is a, c, g, or t
  misc_feature (759)..(759): n is a, c, g, or t
  misc_feature (771)..(771): n is a, c, g, or t
  misc_feature (1040)..(1040): n is a, c, g, or t
  misc_feature (1126)..(1126): n is a, c, g, or t
  misc_feature (1149)..(1149): n is a, c, g, or t
  misc_feature (1164)..(1171): n is a, c, g, or t
  misc_feature (1181)..(1183): n is a, c, g, or t
  misc_feature (1185)..(1191): n is a, c, g, or t
  unsure (1)..(1200): unsure at all n locations
nnnnnnnnnnnnttgtgnnnnnnnnnnnnnaaggcaaaagggggaaatgagaatanctcgattgtgcaacatgcagattcatgtagtggatcnattgacaaataaatcaaactttgacatctttatgcaaacaacgaattgtgcaaaatttaatgcatatatgagagctgggttcttgagatcaattcagattttggagctccaggtgattttgttcncaataataagcaaagcacatctaaacaggtagcagtgcagctagcactagcaagtagaagcgatgcgatcactatatgttgaaaaaaaangaaatagcaacattaacactgccccgcatctaatggtgaatataacatagtaactaatatgaaggcaccnnttttttgggtaaaattacaaacagcagtccaagagcttgcaggtgagcttaatgaaaaaaananatattgttagtgttcttacttgtaggctgcatccacccgatcctgtgcatcgatgtagcttgggaagtcatagccaacaaggaaataatcaccacgcccaaatccagaattcccttcaagggaatccaagagaggttcatagtcatagntgccaaaagcgccactccttataaactgcttggcttcttcaaaacgtgggtctggtttgaactgtcatattgtaagaaacaagtcaataatagctcatctacttataagaaatatgagttgaatgaaaagttcaacagtgaagtttagctgaagctatcttaccagnccattttctctntccttcctcagcccagcaacttcatcggctttggcaccgaaaaggaagaaattatcttctccaacctcctctcttatttcaacattagctccatcaagggtgccaatgataacacaaccattcagagagaatttcatgttgcttgttccacttgcttccataccagcagtactaatatgctgtgacaattcgctaccaggaataagcacttcagccactgatacattgtaatttgggataaagacaacctggcaggaaaaggaaaagancactttaagtaaatgatatggaccatcctgtatgtagtagtatagaaaaagggttactctttttggtggatcacaaatacaaattnatctttctgaagggttcaaaggncaatcgtccattcannnnnnnntaccttcagnnntnnnnnnncttcgggat

SEQ ID NO: 433 - DNA, 614 bp, Zea mays
  misc_feature (3)..(4): n is a, c, g, or t
  misc_feature (21)..(21): n is a, c, g, or t
  misc_feature (53)..(53): n is a, c, g, or t
  misc_feature (295)..(295): n is a, c, g, or t
  misc_feature (347)..(347): n is a, c, g, or t
  misc_feature (382)..(382): n is a, c, g, or t
  misc_feature (448)..(449): n is a, c, g, or t
  misc_feature (480)..(484): n is a, c, g, or t
  misc_feature (487)..(487): n is a, c, g, or t
  misc_feature (490)..(517): n is a, c, g, or t
  misc_feature (519)..(520): n is a, c, g, or t
  misc_feature (528)..(531): n is a, c, g, or t
  misc_feature (539)..(550): n is a, c, g, or t
  misc_feature (552)..(552): n is a, c, g, or t
  misc_feature (554)..(554): n is a, c, g, or t
  misc_feature (567)..(569): n is a, c, g, or t
  misc_feature (585)..(585): n is a, c, g, or t
  misc_feature (587)..(599): n is a, c, g, or t
  misc_feature (605)..(613): n is a, c, g, or t
  unsure (1)..(614): unsure at all n locations
canngtagtaatcgtctggcncagcattatagacagtcaatgcaaggctgggntagcgaatcacttcctgcattggctgaaaccctgagcgagaggcagaatagtctgcacgcatactcggaggcccggcgcagaccgtaaagcagtacctctgttgaccagcagcgtatgcctctttactgtgaaggcacgcataggccgttgagaatttctagcggataaaatgctattgaaaaacaggtataagcagagcacttttggaagattcatccactgcatggtttcgttctgctcnttgcgttacgttcggagacagtagtccatactcgtattggtcaggaacaaanagctaggggtggtatcatctagatcactgaacttntatgctaacattagtccgaacaagttctcttatcctgttaccccggccgtatctctcctgagcttnntatctcccttctcggtaccggccctctatcnnnnntgnacnnnnnnnnnnnnnnnnnnnnnnnnnnnncnngcgatggnnnnctgtgctnnnnnnnnnnnnangnagcctggcatcannnaacagcgcaacaggtnannnnnnnnnnnnnatttcnnnnnnnnnc

SEQ ID NO: 434 - DNA, 552 bp, Zea mays
  misc_feature (11)..(52): n is a, c, g, or t
  misc_feature (82)..(224): n is a, c, g, or t
  unsure (1)..(552): unsure at all n locations
cttgttcaacnnnnnnnnnnnnnnnnnnnnnnnnnnnnnnnnnnnnnnnnnngtcccgccagaatgcatgagacaagttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtaggtcttttgcagttctgaccacctcatggcgtgttccgtagatgggaacctgacccatgacttttttgagtcatggatgtcatgaagaagccaaggacctgttgctggaagcgcgacccatcggaagcactctgggttgacgccgtcgatcatcttgtgtcctgcttgatgaagatcttctcgttgggcgctacagccgtgccatctaggtggccttgtagctgcgcgcctctaaggatgggtagaacttgcgctttctatagcgcgaagttgatcttgttgagctttacagcaacactttgccctaggagagatgttggta

SEQ ID NO: 435 - DNA, 1071 bp, Zea mays
  misc_feature (1069)..(1069): n is a, c, g, or t
  unsure (1)..(1071): unsure at all n locations
ggatggagccatgggatattgtcgctggtgaggttgatgttgacttgctcttgatcaagatgctggctagtagatggaggaggtggctctttttaccatgaaagaaacatggcaccagaatattaaattgcttgccttgacctctaaggtcgatggagctgtatatttatacaggcaggaaccgcctattacaagaggaattctgcttggttacaacatctgaaccgattctgactctaaataaactggacacatgcatcctgttctattttatctctaacttctaatctgagtcggtttctaatctagcccataagatcctggacaactaaggtcgtagcctatgtatagcatattctaacaatgtcaaccccttctgctggataatatcagctcatgacatcacaccacagctggttgatgaggacatgttgtggataattcaaggcccaaagattggaatggattctttttaggtttggtttgatatatgcatgttaatcgctaatgaatacttgttacattcaagttgatttagattgttgatgtcaaggaactttaatgcatgggaccattcaatccatgtctgtatgtggtactatcatttgtctataatagtctactttcccctctttttgtggagtgacttgtgattataacctattgtcataattgtgggcccacgattccgtagcatgcggcacaaagatcaaattggagaaattgtttgagcactagatgcacagttgctaaaagaaaagtgcttgatgccattccactttgaatgcaacagtgtcttgctaacatacttttctgcattggtttttatagcaaatttctttgatgtttctatagtgatgtccggaccaaggctttccaggctactgatcagttcttgcaaatagcaaagcaacaccatgaaaaggtatgcatatctagtttcctatgatgtatctactttgctggatcactttaaccaaccaatattttgcttttaatggtgtgccacatgttgtattctctttatatgttctgaagcactcattgtcttaagacttgagtagggcanaa

SEQ ID NO: 436 - DNA, 770 bp, Zea mays
atagtcatacaagtggaactatcaatgagccacgtgcaaagaggaagaaactgaaatgagccatacggtttgcctccggactcaaggtaccaatagctcttattttttctagattgattgaatatacttgacacattttgctttcacaataagagtaattgtgcctgaaagtgacttgtatttttactttttttttgtatgtatgcttgcctacatatttagttgattatttacatcaccacattgtcagaatatatatattcccctactccgtccctttaaaattgtaagtcgttttagctttttaggtacataacttctgttgtacacctagaatcctagatattattatgggcatgtttggttttgacccctgacaaaaggtgccttgcccaggcagctcccaggccgtcgatttccagcacctgccctggccctggcggccggatctgcctggtcgagtgccctaggccagtgtcccaactagacatatgccctatgtctataactgattatctacgccacaaaatattgccctcattgtctatagtatatgctgatgtggactccctccattcctattgcaagttattttgggtttttcaggtatagcttttgctatgcataatgcatcaatatatatgccaacacagcaacacctgctttgcaccaagcgctaatacatctgtctcacagattggacagcgcagcgaaccggcttcatccttggtctctctgtccatgcgcgcacatgaagtcacgaaaggtgc

SEQ ID NO: 437 - DNA, 721 bp, Zea mays
  misc_feature (9)..(9): n is a, c, g, or t
  misc_feature (39)..(39): n is a, c, g, or t
  misc_feature (215)..(215): n is a, c, g, or t
  misc_feature (501)..(501): n is a, c, g, or t
  misc_feature (634)..(635): n is a, c, g, or t
  misc_feature (680)..(683): n is a, c, g, or t
  misc_feature (685)..(685): n is a, c, g, or t
  misc_feature (688)..(690): n is a, c, g, or t
  misc_feature (692)..(692): n is a, c, g, or t
  misc_feature (696)..(696): n is a, c, g, or t
  misc_feature (698)..(698): n is a, c, g, or t
  misc_feature (708)..(708): n is a, c, g, or t
  misc_feature (714)..(716): n is a, c, g, or t
  misc_feature (718)..(718): n is a, c, g, or t
  unsure (1)..(721): unsure at all n locations
tccagacancaagcttcgacaaggagagaagccgcaaanccaaagtaagcctcggatcgagcacaaccagaccaaaaccgaaatgcgaaggtgaggaccgagccgaggagcgtgcgcgacggagggaacgcaaaggttaatgacaattactactactaaaattactactactaaaacgatgcttgagacgatgggaacaggggaaggaggagtcnccggaggcgatggcagcggcggctcgaagggtagcgaatgcggcgagcaccgcaggcatcgtatcctcgccgggcgcccgcaacgctttatgcctcgagatccaactcggctgatcccggcgactggaaaatagcggcgaaggggaggcgacggcgatagaatccggctaccacgctccgcgcatggaccggatcacggccacggcttcgcttggctcaatttgggtcagaggagacgatgacagaggcgaggaacgggggaaccgaatcagggcgaggccgcggngaggacaacgcaagcgaggtgtggattggctgttggtgcggcgagaggccgctttgggatgtgtctttataatagtccctccgtcccaaaatagattttagcttttttatttatatttaaatggataacgatnnacctaaaactacaacaaattttaatttgggactgagttattggcnnnntnctnnnanagtnantggcgtctgnatgacnnntngaa

SEQ ID NO: 438 - DNA, 926 bp, Zea mays
  misc_feature (3)..(5): n is a, c, g, or t
  misc_feature (39)..(58): n is a, c, g, or t
  misc_feature (240)..(240): n is a, c, g, or t
  misc_feature (272)..(272): n is a, c, g, or t
  misc_feature (277)..(277): n is a, c, g, or t
  misc_feature (304)..(308): n is a, c, g, or t
  misc_feature (376)..(376): n is a, c, g, or t
  misc_feature (447)..(447): n is a, c, g, or t
  misc_feature (502)..(502): n is a, c, g, or t
  misc_feature (909)..(909): n is a, c, g, or t
  unsure (1)..(926): unsure at all n locations
ctnnntccatccgttctctttatctctttgatgacttcnnnnnnnnnnnnnnnnnnnnaactaatgttgtgcatgcatgctgccattatattgctagagctccgtgtaagatgagggtcactagctaggtttactgcctgatcaggtgaagtgatcatctatcctgctcccagcaatcatgcatggcctaccgttcgagagcgagaagccaacggcaggagaggcgaactgggatgcagnagcgcagagcagaccatccggggcagaggcanagagncggggtggtgtctgcgtgcgtggcgcnnnnnagcgcagcgcaggtcctgtcttgttgggcattcaagctaggttgcgaggaggaagcttttggagccgngagggagcggagcgcaggcagaggcagccgtgtctgcgcctggctggccgttcaggtggattgcgaggagntgcagcatcagcacctgagatctgcaaagtttcagtacccatggtggcctcaganaccacaccatcactaaccaacctaaaggcagtctcaatatcctccagagattttgcatctagaacagtaatctcaggatcagctgtagttgtcgctaactcattaatagtggcctctggctcacttgatccagctgctaaggtcgctggtgatggtgtatcatcagcaggcacttctgactcaccatgtggtagtttcatctccacattcattatcattgcttcataggggcttgcttcaaggatccgtctccgaggattgtagacagtctgctcagggtcatcatgagatgctccaaacgagtagccaaattcggagccatttaggtcatcagccaatggagactgctccctggattcttcagcaccaacttccgacatggtcaaggagacattgtcagatgtctnaggactaataacagaat

SEQ ID NO: 439 - DNA, 1066 bp, Zea mays
  misc_feature (39)..(39): n is a, c, g, or t
  misc_feature (114)..(114): n is a, c, g, or t
  misc_feature (119)..(119): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (128)..(129): n is a, c, g, or t
  misc_feature (134)..(134): n is a, c, g, or t
  misc_feature (136)..(137): n is a, c, g, or t
  misc_feature (140)..(141): n is a, c, g, or t
  misc_feature (144)..(144): n is a, c, g, or t
  misc_feature (147)..(147): n is a, c, g, or t
  misc_feature (166)..(166): n is a, c, g, or t
  misc_feature (223)..(223): n is a, c, g, or t
  misc_feature (250)..(250): n is a, c, g, or t
  misc_feature (253)..(253): n is a, c, g, or t
  misc_feature (257)..(259): n is a, c, g, or t
  misc_feature (948)..(948): n is a, c, g, or t
  misc_feature (953)..(953): n is a, c, g, or t
  misc_feature (958)..(963): n is a, c, g, or t
  misc_feature (965)..(965): n is a, c, g, or t
  misc_feature (1026)..(1033): n is a, c, g, or t
  unsure (1)..(1066): unsure at all n locations
catgcctgcagcgcgggcttccagtgccagtggtcctcnctgtggtggtcgcggtggtgcacctcgccggagtccatgatgtcggccagcagctgctccgcggacgaccgccgncgccnccngnancnnggtancnngtnnccngtngccgccgccgttcttctcnatcagctcgtgcagctgcctcttcgtgatcctgatggtcacctcggagtcgtggtgntcctctctcctctcgtcgcggtgatgntgntggnnntggtggtggtcgccctccgacgacaacggcgacgatgacgccgcctcctcccactcgccgtcgtcggcccacgactccgctgcgcgctgcgacgccgtgcagttgcccatggacggtactgctatatatctgcttgaagaaggcctgtggactggactgactttgcggcactaggctgctttgagacggataagtaatgtttaagcagatgggtttcggggagtatttatagggtggggggcgagaggggtggctgctgaagtggggaaggaaggaggcggccgtcagctgcgactgcgagactgcacgtgccgttccgatccttctctgccgttcttcttgtccatgatgtcacgtgggaggcgaggcgggttccagatcccgacgtggcgtgcaggtcatgccccaggtcagaggagctcatcctcgccgggactccgacgaggcagtcgatatgacagatgcctcgcggagacgcgttcccaacaagcactacccgacgtcgggcgaggtggcgtgcgatgcgagtgtgactgggcctctccgtcgacgcggctacggtactcacgactcaccgacacgcggcttgttgggggtggctggggttggtcgcgggcggttgggccggcctggtgtgaatgggctatcgaacgaatcttttgcggtatcaagggcctactgcctcgcgnttttnttttnnnnnntncttttcctcttgcgtaataaaaggaaccaagaaactccgtggagacttgtgtgggtgggtnnnnnnnntcagaagctgtatcgattaggatgagggtttca

SEQ ID NO: 440 - DNA, 842 bp, Zea mays
  misc_feature (156)..(177): n is a, c, g, or t
  misc_feature (416)..(419): n is a, c, g, or t
  misc_feature (827)..(827): n is a, c, g, or t
  unsure (1)..(842): unsure at all n locations
tcgtactaagtaaatttccaaaaaaatctcgaacgcgtaggagagctgtggatcattatattaataagtgaaaaggaatagtccaaaatagactctgaatctcagatacaaggaaaccctcctaaggaggcctaaaacagagataccagcttcagnnnnnnnnnnnnnnnnnnnnnngggtctgacttctgaatggggcccaccatatctattcacattgatttacacaaacgtagtgactagtgagcaatcgtattatcgtgtccaaaaaaaattaatcgatgtcaataaaattttaacatgggaatgcaaagtttttagttaggggtgtttggcatgactctgctctacccaaagcaactctgaagtttttaggatttcggaacagcaaaggaggtactctaaaaattatactnnnnaaaatggaacaagagaagctggagaagctcgcacgcaaggtatgcaaatacacaatatctctaaacattgaattgagcaacatccttttgtgttcaatccagtgttgtcataaaaggctgtgtagtccgtacatgccgtttaaacactacacactgactagctatgtccatttgattggctgtttatcccgtttatttgaccatgtagcctgaataaatgttaaatgataggcgcccatctgtttaccatttagcgttcttgtgaacattggctcaatgataatcttatgctatgttgatgctatgtattttacaaattctcttggaatcatgaatgttttactggtgtatatctttggttatatgtatgtttgctcttgttgagtaggagctatgtcttttttgttntgttgctggaggtta

SEQ ID NO: 441 - DNA, 381 bp, Zea mays
tttattccataaggtgcagtccgagagtcgtagctatttcacaggctactcaggtatgcaattttcactgttccagagcagttcttggatcatgagtgatcctgatggggaaaataccttttgcagatacattgttttgatgccgcgaccatggagagagaatatactgttcttaccagtcctacagttgcacaagtttcaggctatggcccacttggattgggtcctagatggattgcatattctgggaatccagttccggttccagatactggacgtgttagcccacagcttcttagtctatctccctctgttccacctcctggttcaaatggtagtgtggtggcatattatgcaaaagaatcaagcaagcaactggca

SEQ ID NO: 442 - DNA, 604 bp, Zea mays
  misc_feature (260)..(260): n is a, c, g, or t
  misc_feature (415)..(415): n is a, c, g, or t
  misc_feature (496)..(499): n is a, c, g, or t
  misc_feature (521)..(523): n is a, c, g, or t
  misc_feature (525)..(530): n is a, c, g, or t
  misc_feature (539)..(544): n is a, c, g, or t
  misc_feature (552)..(554): n is a, c, g, or t
  misc_feature (559)..(563): n is a, c, g, or t
  misc_feature (565)..(566): n is a, c, g, or t
  misc_feature (568)..(571): n is a, c, g, or t
  misc_feature (573)..(574): n is a, c, g, or t
  misc_feature (581)..(581): n is a, c, g, or t
  misc_feature (583)..(584): n is a, c, g, or t
  misc_feature (586)..(589): n is a, c, g, or t
  misc_feature (595)..(600): n is a, c, g, or t
  unsure (1)..(604): unsure at all n locations
tacctgttaggtctgtcttttaataataataccctttttcctttcgtttggcagctggtattgtcattgaagataagaattggccaccctttatgcccattattcatcatgacatttcgaacgagataccaattcacctgcaaaggatgcagtacctggcgttttcttcactattgggtaagtgtcgatcacttgttgccctcttatcgtgggaaataacttgaagaaagaagtaaattaattggtgacctcattttttnacatccatatgtcgaaataatggatatcctccaaataaatggcatcacagcattatcttgtcatatttgaaatttatcttgtcatatttgaaattgttagtcgcatgggaaatgacattttaatactgagaaatttaatctggattttgacttgnttttttctctttgttctgactggctgcatatacctattgaggtagagaatttcaaacaaatccaagcctcggccttatttnnnnaatgcagttcttgatagtgaannntnnnnnncaacatgtnnnnnntattgctnnnctttnnnnntnncnnnnanntctgatnannannnntcgatnnnnnntgaa

SEQ ID NO: 443 - DNA, 691 bp, Zea mays
  misc_feature (17)..(18): n is a, c, g, or t
  misc_feature (524)..(525): n is a, c, g, or t
  misc_feature (551)..(552): n is a, c, g, or t
  misc_feature (579)..(579): n is a, c, g, or t
  misc_feature (581)..(581): n is a, c, g, or t
  misc_feature (583)..(583): n is a, c, g, or t
  misc_feature (585)..(585): n is a, c, g, or t
  misc_feature (599)..(601): n is a, c, g, or t
  misc_feature (603)..(605): n is a, c, g, or t
  misc_feature (610)..(614): n is a, c, g, or t
  misc_feature (625)..(630): n is a, c, g, or t
  misc_feature (633)..(633): n is a, c, g, or t
  misc_feature (637)..(650): n is a, c, g, or t
  misc_feature (662)..(669): n is a, c, g, or t
  misc_feature (672)..(690): n is a, c, g, or t
  unsure (1)..(691): unsure at all n locations
tgcctgcagcaccggtnnagtgaacctatcgttttaccaaagacttcttcatttacctcatttccaccacctgttgctggtggtggtagagccccttaccctgctcaaggccttacacgtcatgggagcattccatcaattggcgctgggctccaaatgggttctccgagcatgtcactttctgcttctccatatcatatggtcggaccatctcatgggctgccatacacgggaggcatgccttatggtgctcttaacctgcctgtaaacaatccagtgcagaatgattggtcgaatcatgttaaccctttcactggggagcatcttaatctactgcccaatttattgcacaaacaattatcacttcctaatagcccaatgtcgtcactcctattttctcagcatcagcagagattggcacaggtccaatcatcccatcagaattacctcaatataatgccacacgtcctatatccccatcactccgcagagattacaagcaggtttggttctgttggcagttnncattcatcaagagacaagagatcaanntcggggaagggaaaacataacattcgntncncncaactaccatctgnnncnnntagcnnnnntggtgacagcnnnnnnatnaagnnnnnnnnnnnnnncatgtcatctgnnnnnnnngannnnnnnnnnnnnnnnnnnc

SEQ ID NO: 444 - DNA, 575 bp, Zea mays
  misc_feature (241)..(241): n is a, c, g, or t
  unsure (1)..(575): unsure at all n locations
atactggtccttcccctaaaagcatgtcttcctacagtccctggatatttactgttggagcttctgcccatgacagggtatacagtaactatgttgtgcttggcaacaatttgaccattcaaggagttggccttgctcgtaagttcctttgaagtactttttctgtacaaatgtagtcacctctatataattgtaacttgtattgattgattctaaatacagctggaacggatggtgatcncatgtataatttagttgctgcaccacatgcactgaagaacaatacagccagttgtaatgaaatgtcccttggggagtgccaagattcgagtcacctagatgcagatttgataagaggaaagatactagtgtgcagctattctataagatttgtgcttggtctttcttctgtgaaacaagctctagatacagccaatgatgtcagcgccgcaggagttatattctatttagacccatttgttcttgggtttcaactgaacccaactccaatgcacatgcctgggcttataataccatcatctgatgactcaaaggtagggcagccaagagctaat

SEQ ID NO: 445 - DNA, 673 bp, Zea mays
  misc_feature (403)..(404): n is a, c, g, or t
  misc_feature (439)..(439): n is a, c, g, or t
  misc_feature (599)..(605): n is a, c, g, or t
  misc_feature (611)..(612): n is a, c, g, or t
  misc_feature (615)..(618): n is a, c, g, or t
  misc_feature (628)..(628): n is a, c, g, or t
  misc_feature (630)..(630): n is a, c, g, or t
  misc_feature (632)..(634): n is a, c, g, or t
  misc_feature (641)..(641): n is a, c, g, or t
  misc_feature (643)..(644): n is a, c, g, or t
  misc_feature (648)..(652): n is a, c, g, or t
  misc_feature (655)..(659): n is a, c, g, or t
  misc_feature (664)..(671): n is a, c, g, or t
  unsure (1)..(673): unsure at all n locations
gagatgtaatttcttctggcaagtgtggccggcgacacattgatagaatttctgagaatgcaaacgttaagcttctcaaagagaaacttaagctgaaaaaagaacaactaaagcatgtcaagaatgtgtccaagctagataaagcaaaaactgctttaataagaagagagcttcaaagtttaaagcaagactggacacagctactgggtcggtttaacatgctggatgaccaccttgcacgtggtgttgaagatattcatgtcttaacacaggtctgtatcctgcatggtagttattactgtcttcatctatgtttgtggtggtaatttgggtaaaatcaagaatttcttagcaatagccaataggtaactcttacatcctagtagcaacaatgaactgttanngtgttcttcaaatatgtgcaatttggcattttttncatggacttcctttcttctcatgctaataaaaaaatgagttgttaatgaaatcataggggacaatcattcggtatctgaaatagcaccttttttagcgttcgttttttgtcctaaaaaatatcctttgttttttaaagcatatgagtgggggaagcgcannnnnnntgcacnngcnnnnactacatgtnantnnnatatatncnnctcnnnnnacnnnnncatgnnnnnnnnta

SEQ ID NO: 446 - DNA, 379 bp, Zea mays
ttcttcaggaggcaatgtggctgactcagaaataccatccgtaagtagttctgtccggtttgacatgaccgacccttactatggcgagggttaccggagggcctataatacacagaatgctctgcataggttggatggttaccccaacgaaaggttggattcaactgcaccgccgaagcgttgggcatatagccatccaaatccagctgtgaaccttgcatacaattctaatgtatttccacagcagatgggagactactaatttagctagtgggagggatattcagactatatgtatcgccgtggcaatgggcaatggtgatgcctgtatactaataataatactttgtaaacaaaccatggtgccaagtctaaagtt

SEQ ID NO: 447 - DNA, 668 bp, Zea mays
atccgatctcggtacccctgatctcatggaatcatggttcgacgaatgctgaacaacgagttaaatagcctgacagacccacagaaaaaggggtgcatgttgaaatcacctcgcagaaatactatacttatctcgatcggattaatactctttcgtagattgtcagatactttgcatagaagcgtctcttccatctcagatgttgtttagttcacgaaaatgtaacataaatagcaacgatcatgattcacacttggtaacaagtttgaatagaccggtatcagtttctagtatgttattcgattacggttgaactttaacaaacgtggtttaatgttacctatcccattataaatatgtgaaccaaacaacacctttgataacacttcacataagtaattcatcacaaaatcttctatcttcaaagttcagccgtctacggtctaccacatacaaactgcatacgtgcagtagttgccactgagagctgaaggggacgaacgcgatcgctacgatacggagttaaaattgaataaatgcgcagttagtacgaatgcaagatgtctgtgggaagttaattctcctactcggctttttcatcacagcaagagctggaccacattgcattgccttttcatcaacagttaaacaaaacggaaactcgatca

SEQ ID NO: 448 - DNA, 929 bp, Zea mays
  misc_feature (3)..(3): n is a, c, g, or t
  misc_feature (7)..(7): n is a, c, g, or t
  misc_feature (27)..(27): n is a, c, g, or t
  misc_feature (66)..(66): n is a, c, g, or t
  misc_feature (270)..(270): n is a, c, g, or t
  misc_feature (281)..(281): n is a, c, g, or t
  misc_feature (352)..(353): n is a, c, g, or t
  misc_feature (433)..(434): n is a, c, g, or t
  misc_feature (460)..(460): n is a, c, g, or t
  misc_feature (550)..(550): n is a, c, g, or t
  misc_feature (605)..(605): n is a, c, g, or t
  misc_feature (616)..(616): n is a, c, g, or t
  misc_feature (625)..(625): n is a, c, g, or t
  misc_feature (641)..(641): n is a, c, g, or t
  misc_feature (665)..(665): n is a, c, g, or t
  misc_feature (713)..(713): n is a, c, g, or t
  misc_feature (784)..(784): n is a, c, g, or t
  misc_feature (878)..(878): n is a, c, g, or t
  misc_feature (919)..(919): n is a, c, g, or t
  unsure (1)..(929): unsure at all n locations
gcnaaantgacttgacattgcaaaaancacatctggatcctatacactcatcattcacattttttngttaacctgacagggctttgcaagtggaagtcttgacaaagatgctcagtcagtgcgtatgtttgttgctgatggtggtgaactgctcatggctcagagctacgctaagaacatgggattgtatggagagcgtgttggcgctttgagcattgtaagataccttcactcttgttcttgttgatttcacttccgatcatcaggaantcaaggttgtnggcatcttcctctggtgttcagatatattcctatgtttaccatccaacttgtgagcttaatgctatagganngattgatgtgtggaaaattctgccacttgtgttcaaatttgtattttatctccctacttgttacttgagatatgtcagtnnatatagctcgtatctgtttctttatntgaaatcagaagtgcattgctatggatgggttgagttgtcaatcacctgtagtcactggtgactacaattttagccttttgccaggattnaattctttcgcatttgtagaatattatattaatgtagaaattgtttttaatgtanagtggacaacnatttacttncatcagttccagaganatttgactagttaaggatagtcangactttatgccttatctgttaaatgatgatgttatttctcctacattntgcccttttgaacagtcttttaggctgcagagtgtcctattcatagtaactcttatgtttcaggtatgtanaagtgccgatgtagctgttagggttgaaagtcaactcaaacttgtcatcaggcctatgtattcaaaccctcctcttcatggtgcctctatcgtngctaccatactcagggacaggtatcattcttgctattgcantgccatattc

SEQ ID NO: 449 - DNA, 860 bp, Zea mays
  misc_feature (279)..(310): n is a, c, g, or t
  misc_feature (849)..(849): n is a, c, g, or t
  unsure (1)..(860): unsure at all n locations
gcagaacaggatatcactatactcattcaacagtaccattagtccattacaaaccaaagaaggaacccagaaaagactgaggcatctcttcttcaagaactggtttaatcttacactcgacaagaatgctgcagtgtcttttgagttccttcaaaaaggtctagcaaaagtgtctcaagatcctccgccctgtactttacataacgatctcgatgccttgagccatcaagaaagcctgaatatcttcccacgaaggtcctataggcctgtataactttnnnnnnnnnnnnnnnnnnnnnnnnnnnnnnnngttggtcatctgggacagaccatgctgtctgaactcggtaaacctcttcaaaggacagattgaaattttttatcttctccctgatggttttgcgagaagcagcatcaccagaagcacacaagccatcatcactgaggtaagagagaacattattccatgatgccctctcatatctcacagcttgctgctgaaatttcctgttatgaatccggatccagtcatcaccaagaaaacttttgagatccgagttcttcacgatctgaaggatgtagtgggtgttgttcatcatgaagatgttctgcagtcgatcatctctgtacaatctagacccagcttcaagatttgcctccaaaactgcagtaacagactgtagatgcaaagctgttgccgtgaaattaggatatgtatttgccatcaactgaatatcagaagtcaggcatcttcgatccgtgtccttgagaagtgaatcaagaggtttgctgtatgcagtgagagcctttatgtagttcataacatactttgtaagtggatgcatttcnccacgagctac

SEQ ID NO: 450 - DNA, 662 bp, Zea mays
  misc_feature (548)..(548): n is a, c, g, or t
  misc_feature (558)..(561): n is a, c, g, or t
  unsure (1)..(662): unsure at all n locations
atatgggtcatttaactactggaatggctcctgcaactgcaaatgcagaaatggttaattcagatttgacttcccagaaccaaatgttgtcttctttaccgcaaacggatgacagattagctgatggaattgaatccaaatcaggagaagatgtttcacatggaagagtgaggtcttcggctgaaggtaggcccttataaaaggttttcctgtttaagtgaaattcgtcaatcacccatttaaatccctcgagttgtgcccagaactgtgaaactggaaccaaatttgtggggtctaaatttgtttagatcaagtcgtgcctatatcttaataggtgcgatgcatttgagatctggaaactgtagtacagaaatgtttgtatttgatgtaaacattttttttgtttgccccttgcagctatcggaccacaggatgcacagcttggaccagtgcaactaaacgctcagcaacttgaaagtatcagcttaacgcttgctctttgtgccatgttcgctttcccttttacttttagatatcacagattctgntttttttttnnnnacttttccacacattcagtgatttcagtcatattcagattctactcttactaagaaaagtgtaagccaacctaatgaacctaatggcattgttgttgtatc

SEQ ID NO: 451 - DNA, 1301 bp, Zea mays
  misc_feature (18)..(18): n is a, c, g, or t
  misc_feature (72)..(72): n is a, c, g, or t
  misc_feature (80)..(80): n is a, c, g, or t
  misc_feature (544)..(554): n is a, c, g, or t
  misc_feature (563)..(567): n is a, c, g, or t
  misc_feature (583)..(584): n is a, c, g, or t
  misc_feature (589)..(592): n is a, c, g, or t
  misc_feature (613)..(614): n is a, c, g, or t
  misc_feature (616)..(617): n is a, c, g, or t
  misc_feature (627)..(629): n is a, c, g, or t
  misc_feature (635)..(635): n is a, c, g, or t
  misc_feature (637)..(638): n is a, c, g, or t
  misc_feature (649)..(692): n is a, c, g, or t
  misc_feature (1295)..(1295): n is a, c, g, or t
  unsure (1)..(1301): unsure at all n locations
atgtgtagctaagtattngctgtggtaaatctagaagcgtcaaatgattaaagatgacaaaaaaaactccangaactaangcgtaatgcataaataagtagagatccaagtaaaaggtatatctgcaaagaccatgattatgcaatcagtaactcataatgattgggggaaacttgccaaaatcacaaatttttgccggcttccaagctgtattcctgggcaacacctctgacggatattaacaggatgaatgccaggtttcgcttttgttctgtctagtaaagcttcatggtgactctgactccttccatcttcttcgtcttcatcatttgtctgatgacacaggtcaaccctgtaacatcataattttgagaaatataaagctaattagctaaataaaaaaggcattcacaactcaagagaacccccaaaaaatgacaggtatgtaccaccaatccatcacagcaaagtttgaccattgagagaaaacaaggaaaacctaaaagggtctgaggctctgagcaatattacaagcatagagccnnnnnnnnnnnggtgtcacnnnnntgtccaagcgaatgtnncacannnnggatatctaattaagcctcgnntnngtgtcacctnnntgatangnngtacccagctnnnnnnnnnnnnnnnnnnnnnnnnnnnnnnnnnnnnnnnnnnnnctaaaatataatagttacagttatattggcatgtgccaatgcacgacagagttatccaattatcagttatccactgatgctagtaaggatctagttcgagtttctttggggggagtctggctacatgccagccatatgaaagaactacatctacaagagagtgctcagtgtattaacacttcaaccacagtcgcaggaaatgcggtatgcagtgtggctccctgtcccggttccagatcagggttaggtacgaagccgatcgcaagctgggtcgatgcttgggacatcgtcccgaaggccgttggatcattgagaagcataagagcttcatcgttgccatcgtcaaactgccgcatctagctttgtggatgtgggagatatcctgtgatcttccaccgtcaaatgcatcctcggaggctcagatggtgcctgtaagtgttggagacactgtgcggcgctgggctggctggccaggcaccagtggcgtgcgtgacgctagagctgagcgctggaggctggcagtggcgcgtgcgactgtgcctctgatgtatgtccataggatgagagttggactgttggagacctagtgcattggtcaaatgnaccagg

SEQ ID NO: 452 - DNA, 759 bp, Zea mays
  misc_feature (238)..(238): n is a, c, g, or t
  unsure (1)..(759): unsure at all n locations
aagctgcatccatgaaaaagactctctttgatcaggcatgtattatactcgttgtggatatttctaatcaatactttatctttatgcttgcacaaggacctttttcatatgtataagcatgcctgcttgtggtcccatccatggcagacactgctacatgctgtcttatggttttcaatgtttttctttgatatgtcgaatgctgactcagttttatttcgtcgacaggggtacctanatgagcaattttgccaggtggaagacttgcaggatgaagctagtcctaatttcgcggaagaggttgtcactttgtttttcaaggactcggccaggctaatatcaaatgctgaacaggctctgtaagtaaaacatgcagagcaagggagaagtgatttcttgttcagaaaataaagaaaatatgatgcaagcagaagtgttggacttgactgattaaaattttgtgacactgctgcagggaaaaataccccaaagatttcaatagatgggatgcatacatgcagcagctaaaaggcagctgttccaggtatcttggtgctgcatctggatattttttttagttgcatacgatccattctgtgtgactgattcattacagcacacagaccttactttatagttctgtgaacaatgaggactactgagtttaactactgaacatcctgcaaagctgacactatcatttttgaaacaactactgcatgcttcaccttcttaaaaaaagtggggaaaaaaactgaa

SEQ ID NO: 453 - DNA, 653 bp, Zea mays
  misc_feature (146)..(146): n is a, c, g, or t
  misc_feature (179)..(179): n is a, c, g, or t
  misc_feature (208)..(229): n is a, c, g, or t
  misc_feature (311)..(311): n is a, c, g, or t
  misc_feature (335)..(335): n is a, c, g, or t
  misc_feature (341)..(341): n is a, c, g, or t
  misc_feature (346)..(510): n is a, c, g, or t
  misc_feature (542)..(569): n is a, c, g, or t
  misc_feature (582)..(584): n is a, c, g, or t
  misc_feature (586)..(586): n is a, c, g, or t
  misc_feature (588)..(590): n is a, c, g, or t
  misc_feature (597)..(600): n is a, c, g, or t
  misc_feature (617)..(617): n is a, c, g, or t
  misc_feature (619)..(622): n is a, c, g, or t
  misc_feature (625)..(629): n is a, c, g, or t
  misc_feature (635)..(636): n is a, c, g, or t
  misc_feature (638)..(646): n is a, c, g, or t
  misc_feature (649)..(652): n is a, c, g, or t
  unsure (1)..(653): unsure at all n locations
ccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtnttcaaccggacggcatccaagacccagggcctngtctcccgcggcgccagcctcgcggacannnnnnnnnnnnnnnnnnnnnntgccgatgtcatcttcctcatggtcggcttcccctccgacgtccgctccaccgccctcgatccatccacaggcgccctctcnggcctcaccccaggcggtatcctngtcganatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcaagctcatgggaaacgcgctgtacatnnnnnnnnnnnnnnnnnnnnnnnnnnnnaagctgggcaacnnnancnnnatcgcannnnccatggtagggctcgtngnnnncannnnntacgcnnannnnnnnnngcnnnna

SEQ ID NO: 454 - DNA, 519 bp, Zea mays
  misc_feature (13)..(13): n is a, c, g, or t
  misc_feature (15)..(15): n is a, c, g, or t
  misc_feature (58)..(59): n is a, c, g, or t
  misc_feature (100)..(106): n is a, c, g, or t
  misc_feature (126)..(127): n is a, c, g, or t
  misc_feature (129)..(132): n is a, c, g, or t
  misc_feature (153)..(153): n is a, c, g, or t
  misc_feature (182)..(184): n is a, c, g, or t
  misc_feature (288)..(291): n is a, c, g, or t
  misc_feature (349)..(349): n is a, c, g, or t
  misc_feature (384)..(384): n is a, c, g, or t
  misc_feature (421)..(421): n is a, c, g, or t
  unsure (1)..(519): unsure at all n locations
ctagtgctaggcngncggcggtgtgcatgcgtggtcgagctcgatcgagcaggtaganncctgggatttattaatacgtagtacgttacgtacgtacgcnnnnnnngcgtcggtggatagagacanngnnnnacgcatgcaggtagatctgtncaggagccaggatagagatggtgacatgnnncatggagagatccactcccatgcatgagcacaccaccgcctactatactatacgttcagttatgcttgctactagtagaaaaccctgcacgagccactcgtgcnnnnctgaataataagcagacgacgtacgtgtttcgacaacttcaattcgatccaccaggangacaggtgcgcgtgtttagttttctcaccgcgcgnaatttgcacaacagctcaacttctgggtttcgacaanttcatcccgccgttcgccgcaacgagcggggaccagctcctgggcggcgccaacttcgcctccgcggccgccggcatccgcgccgagaccggccagca

SEQ ID NO: 455 - DNA, 414 bp, Zea mays
  misc_feature (193)..(193): n is a, c, g, or t
  unsure (1)..(414): unsure at all n locations
tgctgacactcgatttgttcttcacgatgttgatcaagaaaccaaagaggatgctttactggctcacagtgagaggctggctatcagttacggtcttataacaagtgctccccgctcacctattcgggttataaagaatcttcgatcctgtggggattgtcacacggctttcaagataatctcaaaacttgtnggacgtcagatcattgcaagggatgcaaagaggttccaccacttcgaaaatggtgtgtgttcttgcaaagactactggtaaacaagatgaaagaaagtccacatcttggtcaatttttattggcacaagaccgctataggttgtttatgtgctgaaggtaggctgatgcctatctaacatttagttagctaatagtttcatgtgagagacatgctgtatga

SEQ ID NO: 456 - DNA, 767 bp, Zea mays
ggactcaccaagtgtaagttaaatcatgcttatcaaataccttttcattcttgaacttccatttaatgatagatgtttcattcatcctcaggtgagtcgaaagctaacctattctccagcaaaggataaacctgaggtaagtctatttgatatttgatatgaaggaaacaatccaccatgttctacaccaacacttgaaagaaaaaaaatgaaatatgacatcttttttgaatattttcaatatatgattttttttcaaaaaactttaccaactgttcttaatttcccttttactcttatacaaataatttaactattgcacagacaaaccctcttgatgctgataaaaatagagctcctgcaacaacacttgaatcacctacaaaaaggtctgtagttctcatctcatcatatagtactacttccattagtacattcgctatactatacagctaaactttcatcctacattcatccaggatcaaacaagaccctaagaatcaacaagagtagacgttgtgtgcaacacagtaaggtaaacaatgcagctacaacttcaaatagactaaaactttactctatgattgaaatatcctaccattattggctgcaggaatacttctgaacatcacgcccaaacttcaacaaacgaagcatattcctcactattttgtctataaatattatgtgtgccttcttctatgaagcaaaccttaccctcgatatgctatatataatatctatgtattgtcatgtaatataaccat

SEQ ID NO: 457 - DNA, 653 bp, Zea mays
  misc_feature (154)..(154): n is a, c, g, or t
  misc_feature (174)..(174): n is a, c, g, or t
  misc_feature (179)..(179): n is a, c, g, or t
  misc_feature (243)..(243): n is a, c, g, or t
  misc_feature (283)..(283): n is a, c, g, or t
  misc_feature (362)..(362): n is a, c, g, or t
  misc_feature (608)..(608): n is a, c, g, or t
  misc_feature (615)..(615): n is a, c, g, or t
  misc_feature (617)..(633): n is a, c, g, or t
  misc_feature (636)..(641): n is a, c, g, or t
  misc_feature (647)..(650): n is a, c, g, or t
  misc_feature (652)..(652): n is a, c, g, or t
  unsure (1)..(653): unsure at all n locations
tgcagccctttcctccacaaatgcacggaatggtgcacaccctgttcctggtccaatcaacacgagaggaaccaatggacgtggaggaggcagggacccttggtgtatccaacacgggataagattgcctgcacacaagcataatgtgagaganggtagatggttgtgttttgntcagnactgagcagcgtagctacaacagctaactgaagttaagaagagaggatactaattgcagctaantgaagcagaacatacctttatttggattgagcccggccanccatgtagagcagagtccacgccgggttctcttgaatggagtaacccatgctacgacgctaacggtcaaatggatttgntttgggtgtgccagtggggatgatgagatagaaaaggctcttttcttcagtggaggcgttagttgcaccagccattcaaaaggcatttgcactgaaggaaaatcctccaacacctaaaaatgacactatatcatgtaactactgtgaaccatggaaattaactgaagagaaaaatgggaatattactaccaaaagttattctgcatggcaagccatctatggaaacaatgttgttatgaaaagatncagtgangnnnnnnnnnnnnnnnnnacnnnnnnactctnnnncng

SEQ ID NO: 458 - DNA, 1297 bp, Zea mays
  misc_feature (433)..(439): n is a, c, g, or t
  misc_feature (448)..(450): n is a, c, g, or t
  misc_feature (902)..(921): n is a, c, g, or t
  misc_feature (1256)..(1294): n is a, c, g, or t
  unsure (1)..(1297): unsure at all n locations
ccgggctcgccttcctctgacacctccccgacgtcgccgcctggcggtgatggtggagggtatagtgctcccccttcgccgtccagtgacacctctccatcgacacctggaggtagtgatggagggtgtagcgcaacccctccgccgtccagtggcacctctccgtcgacgcctagaagtggtggtggagggtgtagtgctcccccttcgccatccagtgacacctctccatcgacgcctggtggtggtggtgggtactatggccctccttcgccgtcttctgacacctctccgaccacaccgtctgcgcctagtggtggctactacggacctccgtcgccgtccagtgacacttcgccgaccactcctggcggcggctactacggccctccatcgccgtccagtgatacttcccccacaacccctggcggcnnnnnnngcggctacnnntatggccccccttcaccgtcctctgaaacctccccgaccacgcctggcggcggtggtgggtacacgccgactccacaagtgccgttaccgcctatcagcacatcaccaccgttctctccactgacgccaacaccgactaccccaacgccgtacgaccccaacacgccgcccttcacgggcccatgcacctactggatgatgcacccgggcgtgatctggggcctattcggattctggtgcccgctggtgcggctgttcggtccaagcgcggcggtgccgttcgggcacgacctcaccgtgccagaggcgctggcgaacacgcgcgaggacggtatgggcgctctcttccgcgagggcacggcgtcgctgctcaactccatggtgaacaacaggttccccttcacgacacaggaggtgaaggacgcattcggtgctgcgctcaactctggtgnnnnnnnnnnnnnnnnnnnncaggcacatctgttcaagaaagcaaacgaggggcacgtcatcaggcagaactagctaggcggcgatcgccgtctgtatgtccgtaggcatgcaacaaactgcagtgcaactatgtgcccggcgagcatgcaggacttgcttaggatctgcacgtacgtgtttgatgatatgggggtgaagttattatcacttatctcgatacctctttggatctatcttgtatcagttgcgcatgtggtctttactcctaaagccctgtttcgatacttctggcttattgtttatgaatggttaataattagtcagcaaataattagctagcaaaaatttgttannnnnnnnnnnnnnnnnnnnnnnnnnnnnnnnnnnnnnnagt

SEQ ID NO: 459 - DNA, 519 bp, Zea mays
  misc_feature (67)..(72): n is a, c, g, or t
  misc_feature (186)..(186): n is a, c, g, or t
  misc_feature (209)..(209): n is a, c, g, or t
  misc_feature (214)..(215): n is a, c, g, or t
  misc_feature (392)..(392): n is a, c, g, or t
  misc_feature (395)..(395): n is a, c, g, or t
  misc_feature (445)..(445): n is a, c, g, or t
  unsure (1)..(519): unsure at all n locations
acaggatcaaatggactcccagtcgcaaacactgcttgtccctgtgaattcagatcgttagtgcagnnnnnnaaccatggttaataaaaagttgacgtgactgcggactgagaccattaccttgctccatgtgtaagcttgctcagctgtgcattcagattgtgatgttgggttcgatagggcaanaatgattggtctctgcgtttaanaaaanntactgagcttataaccttgttgcctcaatagactcggaactaacgagttcagttaatggaagttacctcgttaaatgaggagattgcttcaacaacgtcttttgtgaaagtttgccccttcccggatgtgccaatcaacactgttggtttgatagcctggaatgccatttgagtcanganagattcaggtggccatgatacattatagaatccatattttttcttgaggncaaactcatacattaacagcatctaagaggttgctgagtggtttatgctcatgagcccatggtttcttgaagtg

SEQ ID NO: 460 - DNA, 1131 bp, Zea mays
  misc_feature (1)..(3): n is a, c, g, or t
  misc_feature (13)..(16): n is a, c, g, or t
  misc_feature (392)..(392): n is a, c, g, or t
  misc_feature (409)..(409): n is a, c, g, or t
  misc_feature (413)..(413): n is a, c, g, or t
  misc_feature (647)..(647): n is a, c, g, or t
  misc_feature (731)..(732): n is a, c, g, or t
  unsure (1)..(1131): unsure at all n locations
nnngcctgcagcnnnnttcaaacaagaaagaaaatgatgaagttttcattaagctggttagtttccctgtaattaatgctttgataccttaagtttgctgagctttgcacgggttcttcgatgttcttttgttctcgtagggttctgacaaggataagaagaaggaaaatgctgagcgtgatgagcgtgccaagaaggtatgcattgtagttgcaaatcaaagtagtttctgacatatggttgcactgcaattgcatgtggggatggtgtgtggattgtgcatgtgctagagattccgttttacagctcttcagcttaacactttcttattgaatgcttgaatcagagtggatgtagccgtagtacatctcttcagcttaacactttcttcngcttatcaatctttttnagtnacagggactgtaatcttataaatcttaattagatctgaaattgtaagcgtgtgatttgagagttgagaccaagtattccgaatcttcaaccttgatacacaaactctgaacaaggggaaaaagcaaggggcagtcttaatgacccatatgatctgtgtcagttccatgatgtttttgattcttatgttatgtttttgtggttaatgcttagttgagaaaaaaaactgggtgctnatgtgataattatcgtaatcttggggtgcagtcggtgagcatcaacgagttcctgaaacctgctgaaggagaaaggtactacgnnggccgtggccgtggaaggggccgtggggatcgtggtggttttagaggcggatacggagggggatacagtcgtggcccagctgctgctgctccatccattgaagatcaagctcagttcccaagccttggtgggaagtgaagggcgcccagctgctgctgtcaccgagcgttgtgttgtctgctgttgtcatatttaaattttgtccgacgttaaatttctgtgccacggtttaaacggaacaaataatgatgttgcatgtggctatctttagttatgtggtacttgacgttgaataccggagttgttgtttatcagaattaacctccaatttttgtaggccagcttttaccattttgttgtcttagcatgcttgcttgtttggctgtcctgtatggcact

SEQ ID NO: 461 - DNA, 626 bp, Zea mays
  misc_feature (95)..(95): n is a, c, g, or t
  unsure (1)..(626): unsure at all n locations
cagttctgtgcaacatacaaaatttttacgcttactcaccatgtagatatgtttttttagtactcagtgcaatagcctataatgtattttttttnccaacctagaaacttgtggctatttgacatactgaatatgtgaaaccatactgactatgcaaaactatagtttcttccttagataagtgcaaaaactaacttgatattgtttcctgtggggattattatttattcattctggctagaagtttggggaatatatagtcacagatctttgatgtaccataacctttttcattcgcttggtctggactctagaaaacttttgggcattttgtgaagattgcctgcaggctaaacactctgtagggactgactgttagactgttgttttcttgtgttgttttcctgtctaaatgttatgggcctagagcccagcccatgtaatgtgatatatgggtttagggtttagggtttcacttctcgtaacagtgacgcctaatagggggcgggggaggtgaattatgggtatttgtttacttggcccagggtgcctgcatctgctgggctgggccaaggcaggatcggtcaggacttgccggtgcagggtctcttgtttggttgggtgga

SEQ ID NO: 462 - DNA, 460 bp, Zea mays
  misc_feature (40)..(42): n is a, c, g, or t
  unsure (1)..(460): unsure at all n locations
gcagtgtcctcgggtacccacttaccttgcgcatcctggnnnattctgcttctgttcgaactctgcaatctgtctaacgtgtggcctctctgtttgatccgtttgcagagtgattccgagagcactcatgccgcttgaggtgtgtattaaaattattaactgtccttttcttctgttctcttctttgtgtgtaccattggtaattctactagttattactctgctctagcggctaactggttcacatttcacaagagagaattataatatctagctaactgcgaaacaactctcagctaaaaactagaatctggctcgcctttggttttgcacctgcttacagctgttccatttgaaatctatccatgaattctgccctggatgttggtttcacatgatcttgctctagtatgtagcagctcacgtagtcctatgtcagtagtgctctccaggtcaccat

SEQ ID NO: 463 - DNA, 1396 bp, Zea mays
  misc_feature (4)..(9): n is a, c, g, or t
  misc_feature (13)..(15): n is a, c, g, or t
  misc_feature (23)..(25): n is a, c, g, or t
  misc_feature (33)..(35): n is a, c, g, or t
  misc_feature (311)..(311): n is a, c, g, or t
  misc_feature (504)..(504): n is a, c, g, or t
  misc_feature (538)..(538): n is a, c, g, or t
  misc_feature (840)..(840): n is a, c, g, or t
  misc_feature (848)..(848): n is a, c, g, or t
  misc_feature (1021)..(1022): n is a, c, g, or t
  misc_feature (1354)..(1363): n is a, c, g, or t
  unsure (1)..(1396): unsure at all n locations
ttcnnnnnnatcnnngaatcctnnncgccactnnnaggaaagccatattatgttgatatcattgacttgttcaacgaggtaatcatatcttctgacataataaaaaatttcatgctaccaatactggatgcttcttacatatgactgattcacttttcatgttttcaggttgagttcaagacagcttcagggcaaatgttggatcttatcactacccacgagggtgaaaaggatctaactaaatataacttgacagtgtaagtttatgtttcgctgtatcagtaacataattcacacgctttgtttccttncatggtttattgtttagtttccagaatgagttattattatgtgtttagcacctcaaatttaggataaaatcttttatttgtgctaatttctctcaatgattttcattttgcacagtcaccgccgcatcgttcagtacaagacagcttattattcattctaccttcctgtaagagttattgctctatatattcntctcagtcatctggatgttagcatttcaatttgntgagtgtggtaataagtttctactccattcaaggttgcatgtgcattgctgctggctggtgagaacttggaaaactttgttgatgtaaagaacattctcgttgaaatgggaacatactttcaagttcaggtaatgctcttgtttttttaaggccaaatgacatggatttgctatattgggctacctctgatcattggcatttttctacaggatgactatctagattgttttggtgatcctgaattcattggcaaggttagatgtttgcacattctctttctactatatagaataagtgctantgttggancaatcgcgaccaaggccctgttttcttgaacttgatctcatcagtatttattcttatcacagatcggaactgacattgaagactacaaatgttcctggctagttgtgcaagctcttgagcgtgctgctgagaaccaaaagagcattctgtttgtaagcactattaaactggcnnaatctttttcacaacataaacgacaaagtaagaaaatccttcatgtctgttcaaacaggaaaattacggaaagtctgatccagcgtgtgttgcaaaggtgaaggacttgtacaaagagcttaaactggaggtttgttctgaacattccatgttcttattatttattgttccgtccaccatgtaagcatcacgcctgtttgttgttattattatccggaaacaattaaacccaacgtatgatggtcatggtgcattgacctggttaaaggcactgaaacaatggtcatattgtctgcatgtggatgtacgcatttacatgtggctgctctccnnnnnnnnnnttttcgttatatgttctgttctggtggtgacgt

SEQ ID NO: 464 - DNA, 475 bp, Zea mays
  misc_feature (16)..(17): n is a, c, g, or t
  misc_feature (46)..(46): n is a, c, g, or t
  misc_feature (49)..(52): n is a, c, g, or t
  misc_feature (70)..(70): n is a, c, g, or t
  misc_feature (72)..(76): n is a, c, g, or t
  misc_feature (80)..(80): n is a, c, g, or t
  misc_feature (93)..(95): n is a, c, g, or t
  misc_feature (100)..(105): n is a, c, g, or t
  misc_feature (118)..(122): n is a, c, g, or t
  misc_feature (133)..(134): n is a, c, g, or t
  misc_feature (145)..(145): n is a, c, g, or t
  misc_feature (158)..(159): n is a, c, g, or t
  misc_feature (177)..(182): n is a, c, g, or t
  misc_feature (184)..(185): n is a, c, g, or t
  misc_feature (216)..(216): n is a, c, g, or t
  misc_feature (220)..(221): n is a, c, g, or t
  misc_feature (350)..(356): n is a, c, g, or t
  misc_feature (362)..(362): n is a, c, g, or t
  misc_feature (387)..(387): n is a, c, g, or t
  misc_feature (397)..(400): n is a, c, g, or t
  misc_feature (406)..(407): n is a, c, g, or t
  misc_feature (417)..(417): n is a, c, g, or t
  misc_feature (420)..(421): n is a, c, g, or t
  misc_feature (444)..(446): n is a, c, g, or t
  misc_feature (465)..(465): n is a, c, g, or t
  misc_feature (467)..(468): n is a, c, g, or t
  unsure (1)..(475): unsure at all n locations
catacacttctcaganntaaatgatataattaataacacgactgtncgnnnnattacctgtcggaagaangnnnnnggcnaaagcactgctcnnntctannnnnnacacagtaggggnnnnntcacctaaccnntatgagaaaantatggcatttagnntataataaatataaaaannnnnntnncactcactttatgaccatttttatacttacnagtnnatcaccagtatctgcaatctcaggcttgggaggcaaagctatttgggaagaaggaactggagcaatttcttcaacaacttgcagtttctccgctacaattggaacggtatcacgaacttcttcttctgnnnnnnntgtcanaagaagccgctcaggaagctcctgntgaaataagnnnnatagtnngtatttaagnatnnattccacaataagtaaatcggcnnntataaacttgacttgacgntnntcattta

SEQ ID NO: 465 - DNA, 1156 bp, Zea mays
  misc_feature (16)..(16): n is a, c, g, or t
  misc_feature (154)..(154): n is a, c, g, or t
  misc_feature (212)..(212): n is a, c, g, or t
  misc_feature (265)..(265): n is a, c, g, or t
  misc_feature (285)..(290): n is a, c, g, or t
  misc_feature (320)..(320): n is a, c, g, or t
  misc_feature (323)..(324): n is a, c, g, or t
  misc_feature (327)..(338): n is a, c, g, or t
  misc_feature (526)..(526): n is a, c, g, or t
  misc_feature (592)..(592): n is a, c, g, or t
  misc_feature (702)..(702): n is a, c, g, or t
  misc_feature (710)..(712): n is a, c, g, or t
  misc_feature (719)..(719): n is a, c, g, or t
  misc_feature (940)..(940): n is a, c, g, or t
  misc_feature (1018)..(1018): n is a, c, g, or t
  misc_feature (1033)..(1033): n is a, c, g, or t
  misc_feature (1060)..(1060): n is a, c, g, or t
  misc_feature (1110)..(1130): n is a, c, g, or t
  unsure (1)..(1156): unsure at all n locations
aagtgtaacatgtttntcaactcgggttgcgtctgtttctcgtttggcttcttctatccggcttcttgaaggatttggtttcttcgccgccggccggagctggacggccggcctgtcaattttacttcggttgtcgaaggattcgctctcttcntccgcctgttatttccgcgctctgtcgttctggtatttcgatttcatgttcctgtcgnagtttggttgatccgaaatatgcatctctacgctggtttcgcgaattccagcngccgttctttactctcctgnnnnnngactccgcgtttttaaggattctgcacgcnaanntcnnnnnnnnnnnngtctcatgtttacctggccgtctcccaaattccgctgctttcccggcagtttctggaaaaagaacgagccatccatttgttgttgtttcagatttgccccctccgatccttttgtggcccagagatggccagtcatgtagtttatcgctctgccgccggagtcaaatttctgattggtctgcggccgncttctcttccgagttgcggagttcttagtgatttttgttcttccctccacgcctcgctttacttgntttcgtttcaacgagctggttcatgttggaattttgcggtcgttttgttctctctccctaaggcgctgggcctggtgatcgttctgttcgagtgctcgtttcatagccgnttccaacnnnggagcgngcgatctgtcacttgcattttgcagccgatctccttgttcgatgtcacatagctaagactcgcctcgcctcttgattcgttgcaggtaccaaaggctgagcccggactgcctcccgctcggcaacggcggtggcggaggcggaggcgccgtgccccgcaagcaggcgtccagatcctcctacatcagagaggacgacgccccggccgtggccacggatggntcccgcctcgcatcgtacctggcggcctcctcgcacgagcccaagccgctgcgggcccgcgcgccgcagccggcgccnctctcctcggtggcnggccggagcccagcgcgcgaccacgcncaccaccaccacacctccgactcctccgacaccgcctccccgagctccannnnnnnnnnnnnnnnnnnnntcgtcggcgacgtgctgctgcaggtc

SEQ ID NO: 466 - DNA, 756 bp, Zea mays
  misc_feature (15)..(15): n is a, c, g, or t
  misc_feature (47)..(47): n is a, c, g, or t
  misc_feature (55)..(55): n is a, c, g, or t
  misc_feature (65)..(65): n is a, c, g, or t
  misc_feature (77)..(77): n is a, c, g, or t
  misc_feature (170)..(170): n is a, c, g, or t
  misc_feature (501)..(501): n is a, c, g, or t
  misc_feature (627)..(630): n is a, c, g, or t
  misc_feature (638)..(638): n is a, c, g, or t
  misc_feature (650)..(659): n is a, c, g, or t
  misc_feature (664)..(674): n is a, c, g, or t
  misc_feature (676)..(677): n is a, c, g, or t
  misc_feature (679)..(683): n is a, c, g, or t
  misc_feature (691)..(694): n is a, c, g, or t
  misc_feature (705)..(708): n is a, c, g, or t
  misc_feature (712)..(718): n is a, c, g, or t
  misc_feature (720)..(720): n is a, c, g, or t
  misc_feature (722)..(735): n is a, c, g, or t
  misc_feature (738)..(738): n is a, c, g, or t
  misc_feature (742)..(748): n is a, c, g, or t
  misc_feature (750)..(755): n is a, c, g, or t
  unsure (1)..(756): unsure at all n locations
agaaataaaagctanagcggttgcccaaaatgtctgataatcttaantgcatatncttttctccntctctagggctnacggaaacctgcgctgggtcctttgtttccctgccgaacaacatgtccatgctgggaactgtcggccctccagtcccgtatgtcgaagtacgnctggagtctgtccctgagatgggttatgatgcactgtcgagcgagacgcctcgtggggaaatttgcatcagaggggacaccttgttctcgggatactacaagcgagaggacctaaccaaagaagtcttggtcgatggctggttccacacaggtaccatcggtccctgttccagtattcctccatgtcagcatcactatgagtcaagaaaatgtcaagggaaagaaaatgtgaagggaactggtgctttcgtagccgtgctttgtcaacaatttgcattaactcccggaagatcattgataactgtcttgaaagagatcctgatttaacttnccatcagaaatgcctttgaaattttcccaagtctaacgtttgttcactgccaaatattaatatttactgcaggagacattggtgagtggcagtctgacggaagcatgaagatcattgaccgcaagnnnnacatcttnaagctctcacannnnnnnnnngttgnnnnnnnnnnncnngnnnnnatctttgnnnnaactcctgctnnnnattnnnnnnngntnnnnnnnnnnnnnntcnacannnnnnnannnnnnt

SEQ ID NO: 467 - DNA, 472 bp, Zea mays
  misc_feature (286)..(286): n is a, c, g, or t
  unsure (1)..(472): unsure at all n locations
tcatcgtttagaaggtgatttgggaaactgcttctgatgaggacttgccatgatcaagagcatggtgccttgattaatgtgttctttagaagttcacaaattatgctctggtttgccagtccgccttgcatctgatctaaaccttctctaatgaagggatggtgtgacagataatactagcataactagcttaattttccctttaattcaaagtgtattactagttttgtggttaccagttttctttataaagatctgagtcacagttgatgggttggtacttgtntcatatatcttcggtgatactgacatctgactaccatagattgttttttattctcttgcagcttttgactgttctggaaggtgcaataagaccagattgcctctcttctgattttgaaacaagtgagtgtctaaactcacaggttggatctgcttctgtccttccatgggttcccgacactacttc

SEQ ID NO: 468 - DNA, 630 bp, Zea mays
  misc_feature (627)..(627): n is a, c, g, or t
  unsure (1)..(630): unsure at all n locations
gaatccctgggtttccctaccattgctcaggctttggggaatctcaaagattccaaaaggtcttgcaaggtcaagaagtgtttcatcctttccgaggaggatgtttggctgatggccatataagaactgctggcatgtatcaacctgacggtaggcatgtatctggtgcagcttataaatggtctgcaccacaagggtatgatttcccacagccagcaaaaccggtttttctgttgcaagaatcatccccatcatctgtgatgatgtttccacaaactagatctaagataactcacttggaatatgagtactcaagacatgaggatggtagacttgataggactgttcctactcaagacatgggaagaagcaatcaaacattatctctttggcctcatcttgtttcaggcgaagcaatagaagaatgtactggaactgtgaatatgcactcccccgtcagtggtgcagagcatgaatcaaacaatgagagtacagttgaaaatggctgcaaaatctttggtatctcattggctgaaaagatccgatcatgcgatgaagcagactcttgtagtgcaaaatgtaattctcggctccagcctttgaagtcacaaatgccaaaatcgctangca

SEQ ID NO: 469 - DNA, 668 bp, Zea mays
  misc_feature (38)..(38): n is a, c, g, or t
  misc_feature (374)..(374): n is a, c, g, or t
  misc_feature (593)..(593): n is a, c, g, or t
  misc_feature (616)..(633): n is a, c, g, or t
  misc_feature (638)..(639): n is a, c, g, or t
  misc_feature (644)..(644): n is a, c, g, or t
  misc_feature (648)..(653): n is a, c, g, or t
  misc_feature (655)..(657): n is a, c, g, or t
  misc_feature (659)..(662): n is a, c, g, or t
  unsure (1)..(668): unsure at all n locations
cttttatggatgttatctgccattcctatttttttttnctcgaaaacgcatgaggactgcgtctcattatattaagtgccattccttttttaattgattggaaataatttattgactctatgttactcttatgctaaaattcttaatttcttatgagtttattgatattgtcttttgtttcccccttctcttgatcagtgaaatgtctaaaccttggaagatgcatcatctacatgcctagaattgatctgtgggcagttgataaggcccataatcaaatagaagataatatgctcaatactggggcaggtcgtttagcatcctccaccgctgatcacaaaaaatgttcagaagtttggaatgcattgattgancaaatggattcattgttagcttctgtatcaataagtgttctggtaagtctgatataccccacaccacatgtttcttcgttgtttttgtgtaatttagtgtccttttttccctgtaaaatgtaaaaaaagaattattcatggtgagctgataggaaaaatactttattaacatgttggtgattagcatcgactgaatattaccactgcaatttttttttngcaatataatcacctactacatnnnnnnnnnnnnnnnnnnctagnnccctnctcnnnnnnannntnnnnaatttg

SEQ ID NO: 470 - DNA, 551 bp, Zea mays
  misc_feature (3)..(7): n is a, c, g, or t
  misc_feature (10)..(12): n is a, c, g, or t
  misc_feature (230)..(235): n is a, c, g, or t
  misc_feature (268)..(268): n is a, c, g, or t
  misc_feature (319)..(321): n is a, c, g, or t
  misc_feature (331)..(331): n is a, c, g, or t
  misc_feature (363)..(365): n is a, c, g, or t
  misc_feature (381)..(381): n is a, c, g, or t
  misc_feature (412)..(414): n is a, c, g, or t
  misc_feature (457)..(462): n is a, c, g, or t
  misc_feature (497)..(497): n is a, c, g, or t
  unsure (1)..(551): unsure at all n locations
gcnnnnncannnaccgatatgcatggcacgcgcgcgcggtcccgtctagaggagtaaatcgtcgtcggtgaaaaaaaaaacgaaggattaaagagggtaagcatcaacaagaaccaaactactatctcttatctagctagcttccttcctcacattagcttgctgcgcttgcgatggcggtgagcaattgggatcgattcagggctggatgttaccgccgccgccgccgnnnnnnaaggacggcagcatgatgtcctgcaggagcccnaagtcctgcgccatgaagtgctgcatctggagcgaggggggatacgacggnnntgtggtggangtagtagtaatggtggcggccgtcgtcgtcgnnncggcgccagccacggngctcatcgggccgccgctcatgccgtggttnnngcgcgggggcaggagccccagcatgtcgatgacgcctccgccnnnnnnaccgcctgctgcccgcccgaacggcgccgcgcccntctgcggcagcggcgtcgggaaggcgccgaggtggtggttgtggtggtggtgca

SEQ ID NO: 471 - DNA, 651 bp, Zea mays
  misc_feature (93)..(93): n is a, c, g, or t
  misc_feature (97)..(97): n is a, c, g, or t
  misc_feature (140)..(140): n is a, c, g, or t
  misc_feature (533)..(533): n is a, c, g, or t
  misc_feature (556)..(565): n is a, c, g, or t
  misc_feature (567)..(570): n is a, c, g, or t
  misc_feature (572)..(574): n is a, c, g, or t
  misc_feature (588)..(593): n is a, c, g, or t
  misc_feature (595)..(597): n is a, c, g, or t
  misc_feature (600)..(616): n is a, c, g, or t
  misc_feature (620)..(648): n is a, c, g, or t
  unsure (1)..(651): unsure at all n locations
aatagttgcctcggttctcagggcaacagtgtgcatgaccttaacagctttcaagggaaatctgtcgcaaaataaaagtcataagcttagcgncatncatctgtcgtgatcttcaacatatatcacggaagggaaacacnccagaagacttgcaaatatatgcatacaacccaaaacaaggcaacagcttttttaactaaaactacaaaaagtattaacatatatgtttgcaacaatatcgttctagcagctttattctttgaataattgagccaaaccaggcaatccattgttagttagttcgataaaacttcaaaggaaactgaaagaatacatgccgtatagatgttaggttcctgatttgatacactgaaaatatagttaaacagtaaattccatttccatagaaggaaacataaggggcagcaattccatccataacattatttttcaggtattaattcatacgttacttatgatatatctggaacttttgaagaatgcagtcaccaaataacaataatatagcagtncaaaagcatactaaaacaaacannnnnnnnnngnnnnannnaaaatatatatgannnnnntnnntannnnnnnnnnnnnnnnnatcnnnnnnnnnnnnnnnnnnnnnnnnnnnnntga

SEQ ID NO: 472 - DNA, 758 bp, Zea mays
  misc_feature (7)..(7): n is a, c, g, or t
  misc_feature (14)..(14): n is a, c, g, or t
  misc_feature (109)..(115): n is a, c, g, or t
  misc_feature (156)..(157): n is a, c, g, or t
  misc_feature (184)..(184): n is a, c, g, or t
  misc_feature (197)..(198): n is a, c, g, or t
  misc_feature (202)..(204): n is a, c, g, or t
  misc_feature (206)..(207): n is a, c, g, or t
  misc_feature (214)..(214): n is a, c, g, or t
  misc_feature (301)..(301): n is a, c, g, or t
  misc_feature (308)..(312): n is a, c, g, or t
  misc_feature (491)..(491): n is a, c, g, or t
  misc_feature (551)..(551): n is a, c, g, or t
  misc_feature (554)..(557): n is a, c, g, or t
  misc_feature (749)..(749): n is a, c, g, or t
  misc_feature (751)..(752): n is a, c, g, or t
  misc_feature (754)..(755): n is a, c, g, or t
  unsure (1)..(758): unsure at all n locations
ctggctnccacggnccgccagctcggaccacgccctcgcggggccccgcgtggcagccgctgcacggtggccgccgtacctcgcgccgtcgcgctcgcaggggcgggannnnnnngcggtgtttcgattcggtggcgttctcgtaataaggtacgnnaaacggagggctttctaggcgtcgggntagatgctgcagnntgcnnngnngtgcagnggctccaaaaaggacgagaccatggttgctggctcgctcgctcgctcgaggctcgagtgcgtttctaacgctgcccacaccacaccncacaccnnnnnagcctagtcgagaagaaagaaacctccggtctctgggtcaggttctcgccgagcacgcgatttcacccgtcctttcggttcaggtaacctcctcccgtgtcttggtctggattctgattcccacctgctgctgttattggcttctgttcccccgagtttgtttgatctgataggttgcngtgtgctcgctgcgaccggtttgcgatctctgaccatgctttgctttcgttttcttttcnttnnnnctcgtcagatcttgtttcggattcgacaggcgagggtgggagttatagaggagagccggacatttcggcgcggtatgtctcttggttctctcagtttttatctggtgtttcttgtttccgcgattacgtgggctgcgctagtcaagaacttctgtaggaatcttggatggatcggtttgtggcctgcaggtncnnanntgg

SEQ ID NO: 473 - DNA, 506 bp, Zea mays
  misc_feature (59)..(59): n is a, c, g, or t
  misc_feature (78)..(78): n is a, c, g, or t
  misc_feature (360)..(360): n is a, c, g, or t
  misc_feature (437)..(437): n is a, c, g, or t
  misc_feature (439)..(439): n is a, c, g, or t
  misc_feature (446)..(446): n is a, c, g, or t
  misc_feature (449)..(449): n is a, c, g, or t
  misc_feature (451)..(452): n is a, c, g, or t
  misc_feature (460)..(484): n is a, c, g, or t
  misc_feature (489)..(496): n is a, c, g, or t
  misc_feature (501)..(503): n is a, c, g, or t
  unsure (1)..(506): unsure at all n locations
gcatcagccactgtagcatctgatggccttgcctcgtcatgactgccctgtgatggagnaacttgattcatggggacnccttgtgccccaggagtaccatgagccatgggagcaccttgagccataggagcacctataggcccatttgacgcctttgctgcattagggagaccaggttttgctccagcctttttaatcacgatcggaggtgcagataggggaggcatcccaggaggaagtatttcaatgggaggctttttctcagtttcccccaagcttgtgagctttggatcctcaagagaagccaagaatgcggcggcggcatcggtttttacagtcggtgtgtgatccagttccttntgtagcatcttgttccatgttataaccaagttccttaatgatggacgaccatgggcctatagagtttattaggctantnagcatancananncatacaannnnnnnnnnnnnnnnnnnnnnnnnaaaannnnnnnnaatgnnntaa

SEQ ID NO: 474 - DNA, 501 bp, Zea mays
  misc_feature (1)..(1): n is a, c, g, or t
  misc_feature (4)..(8): n is a, c, g, or t
  misc_feature (10)..(10): n is a, c, g, or t
  misc_feature (80)..(80): n is a, c, g, or t
  misc_feature (362)..(362): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (448)..(448): n is a, c, g, or t
  misc_feature (462)..(464): n is a, c, g, or t
  misc_feature (473)..(473): n is a, c, g, or t
  misc_feature (475)..(480): n is a, c, g, or t
  misc_feature (484)..(486): n is a, c, g, or t
  misc_feature (491)..(495): n is a, c, g, or t
  misc_feature (498)..(499): n is a, c, g, or t
  unsure (1)..(501): unsure at all n locations
ntgnnnnngncactgtagcatctgatggccttgcctcgtcatgactgccctgtgatggaggaacttgattcatggggacnccttgtgccccaggagtaccatgagccatgggagcaccttgagccataggagcacctataggcccatttgacgcctttgctgcattagggagaccaggttttgctccagcctttttaatcacgatcggaggtgcagataggggaggcatcccaggaggaagtatttcgatgggaggctttttctcagtttcccccaagcttgtgagctttggatcctcaagagaagccaagaatgcggcggcggcatcggtttttacagtcggtgtgtgatccagttccttntgtngnancttgttccatgttataaccaagttccttaatgatggacgaccatgggcctatagagtttattaggctagtgagcatancaaaatcatacaannngtggacaantnnnnnncaannnaaaannnnngannat

SEQ ID NO: 475 - DNA, 717 bp, Zea mays
  misc_feature (125)..(149): n is a, c, g, or t
  misc_feature (178)..(178): n is a, c, g, or t
  misc_feature (211)..(211): n is a, c, g, or t
  misc_feature (239)..(239): n is a, c, g, or t
  misc_feature (257)..(257): n is a, c, g, or t
  misc_feature (382)..(382): n is a, c, g, or t
  misc_feature (638)..(639): n is a, c, g, or t
  misc_feature (650)..(650): n is a, c, g, or t
  misc_feature (652)..(652): n is a, c, g, or t
  misc_feature (666)..(668): n is a, c, g, or t
  misc_feature (685)..(685): n is a, c, g, or t
  misc_feature (708)..(710): n is a, c, g, or t
  misc_feature (712)..(712): n is a, c, g, or t
  unsure (1)..(717): unsure at all n locations
gcattccgcaaggcaaagcattcgtcccaccttgccaagggaacaagcactagtgcccaggtatgctaagggaacaagcactggtgcccaggactccagtaaggtcgatgctttgactgagctgnnnnnnnnnnnnnnnnnnnnnnnnngggcgtttggggcttgagcctgaaaaatnggaactttcctatataagaaacaggaactttcnccgatataaaaacgggaacagagaatanggtcctgattatcctatnttttaccctgtttccatattttactgaaagtacgctaaacaatcggtaaatacgataaacggtgtcgatcggtacaggacttctctgtcatgtttttatctccagctccagctgctatggaatgnattagttttgttggaaaagtagaatgcagtaacttcatagcattcttttgtatgatgtaatctctatatgctgattcagaatcatgtctgttgcacaggttgctcagatatgatgaaccaatctctcttcttggttggagaaatcgggggcaatgactacaacggacctcttctttctggagttcccatggagaaaatccgtgccatcactccgagtgttgttgcaaaaatttcttctacaatcagcgtgagcatnngttttattgtngntgttgtagctgctnnngtcatatatagatagtnatttacaatacgttgagtttgcnnnanttgat

SEQ ID NO: 476 - DNA, 1089 bp, Zea mays
  misc_feature (16)..(21): n is a, c, g, or t
  misc_feature (69)..(75): n is a, c, g, or t
  misc_feature (107)..(107): n is a, c, g, or t
  misc_feature (121)..(121): n is a, c, g, or t
  misc_feature (425)..(429): n is a, c, g, or t
  misc_feature (433)..(433): n is a, c, g, or t
  misc_feature (442)..(466): n is a, c, g, or t
  misc_feature (468)..(468): n is a, c, g, or t
  misc_feature (482)..(484): n is a, c, g, or t
  misc_feature (487)..(501): n is a, c, g, or t
  misc_feature (504)..(513): n is a, c, g, or t
  misc_feature (521)..(699): n is a, c, g, or t
  misc_feature (702)..(705): n is a, c, g, or t
  misc_feature (708)..(708): n is a, c, g, or t
  misc_feature (711)..(712): n is a, c, g, or t
  misc_feature (714)..(720): n is a, c, g, or t
  misc_feature (725)..(727): n is a, c, g, or t
  misc_feature (729)..(731): n is a, c, g, or t
  misc_feature (733)..(737): n is a, c, g, or t
  misc_feature (740)..(741): n is a, c, g, or t
  misc_feature (746)..(748): n is a, c, g, or t
  misc_feature (750)..(758): n is a, c, g, or t
  misc_feature (764)..(764): n is a, c, g, or t
  misc_feature (770)..(789): n is a, c, g, or t
  misc_feature (792)..(796): n is a, c, g, or t
  misc_feature (852)..(852): n is a, c, g, or t
  misc_feature (981)..(981): n is a, c, g, or t
  misc_feature (983)..(983): n is a, c, g, or t
  misc_feature (1007)..(1010): n is a, c, g, or t
  unsure (1)..(1089): unsure at all n locations
aagttgtttggcgtgnnnnnncttgatgttgttcgtgctaagactttctatgctgggaaggctaatttnnnnnnnaccggtaatagttcgagctttactttaaaatngtggaaataaagangtatggttttagccttcttctctcactgtctattcctttgtcccccaccccaccccaccagatgtgaatgtccctgttgttggtggtcatgcgggtatcactatcctgccgttgttctcacaggtaatttggctttgattcattttcttaaaagcaatgtttccatgccttgcatattattaaatattaatcctcaatgagaaattataaatcagatctgaaattagtagcattttcttttttcccatccagtattcgataacattttattataccttatatgcctatcacgccaagatagaannnnnatgntcatttgcnnnnnnnnnnnnnnnnnnnnnnnnnantatgcatcaaatgnnnatnnnnnnnnnnnnnnngcnnnnnnnnnntgacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnatncgnngnnnnnnntgatnnngnnncnnnnntanncagtnnncnnnnnnnnntcaacntgtaannnnnnnnnnnnnnnnnnnnctnnnnntgattcaaggaagctttcatttgaaataggccacccctgcaaccaacgcattgtcngatgaagacatcaaggctctcaccaagaggacacaggatggtggaactgaagttgtcgaggcaaaggctgggaagggctctgcaaccttgtccatggcgtaagtcagaaaatgagggaaaaaaactatncngtctctgcatttcttactgctgtnnnnctaaatagttttcccctttatctgttttgtaatctatattttcgtactattgcaggtatgctggtgctgtttttgcaga

SEQ ID NO: 477 - DNA, 1216 bp, Zea mays
  misc_feature (149)..(149): n is a, c, g, or t
  misc_feature (332)..(332): n is a, c, g, or t
  misc_feature (419)..(420): n is a, c, g, or t
  misc_feature (437)..(437): n is a, c, g, or t
  misc_feature (450)..(450): n is a, c, g, or t
  misc_feature (711)..(711): n is a, c, g, or t
  misc_feature (951)..(951): n is a, c, g, or t
  misc_feature (1064)..(1064): n is a, c, g, or t
  unsure (1)..(1216): unsure at all n locations
tgtacctcatgtctgatacttctggcctctctcatggtccttaccttggaacaacaactttctgttccttggcttctctgctcatcttgttaattaaggcatctgtttatagtccggcgcaggacattgggcctgagctctcgccgtcnttaccagatcacaagctcaatctcaagaatctatggggaatgcctgtacttttcctgtcttccttggtgtttgctcttggccatgttattgttgcttacagaacaagcggcagggctcgacggaagcttctcattcaccgcattgaccctgaatcggtatgactgccatgcatttggttttgntcttctaaatctcataaagtcatcaatttataaataacttgagattctttctttacaacttgatcactggttgatgttaactttgannatttatgaatttttcgntttcctactattnttgttttcagattttagcatacaagaatgccttttctggatgctacaaggttccacggtctcctacaccatacagcggaaagctttttacaaggagtgaaagtgagactaagagaaaatcacttatccaggacgatcgtgatttgccaatcagttttcttgcagacagtgatagcatgttcattgcttgccaggggatcactatacactacaaagtttccgatccagcagccagcctaccttcatcccctggcttcttttnagagagagatactcatcacgatgtaatttcatcaagcatttctcctagaagacagaggcatgagagtccaccatctgcttcctctaatacccgtcgcgttctgaataggagctttagccatcaataccataatacttcgctatatgcaccactattggtagaaccagtggcatctccaactttgttggatgatattcctctgatgtgtattgatgatggcaatgctgatggatgtctgantcatgtgggctttgaccttgaggctggagggcagggtaaattcgctgtagttttggtgcatggatttggagggggagtattctcgtggagacatgtttccaatttgttagctngacaattgggatgcactgtgatggcatttgatcgcccaggatggggattaacatctcgacctcgtagaaaggactgggaagataagaagttaccgaatccatatgagctggagtctcaggtgacccttttctccactcaatgcaagtctagt

SEQ ID NO: 478 - DNA, 732 bp, Zea mays
  misc_feature (8)..(13): n is a, c, g, or t
  misc_feature (41)..(41): n is a, c, g, or t
  misc_feature (109)..(109): n is a, c, g, or t
  misc_feature (122)..(122): n is a, c, g, or t
  misc_feature (250)..(250): n is a, c, g, or t
  misc_feature (715)..(716): n is a, c, g, or t
  misc_feature (724)..(730): n is a, c, g, or t
  unsure (1)..(732): unsure at all n locations
gccttctnnnnnnttactgagtagcgagcgttctagtttcncttggtcttgggcagccttctccctctccaggtcttgcttagccaggctcgagaactgcttgtccaangagctcgccgcgnctagccacgcgagaacgatgaccaggagtatgcccccaaggtatggagtcgaatttgccagggatccgaacgtcaggatcatgaactgttggataagtgcgccgcccgacttgcccagtgggttgcanacaacatcaatggctgcctttccttttacctgcaaacagagggaactggaattggcatgtgcagtataataatggtgcaggcaccgggacatcaagaatcattgagcccacccacgcatgattctagctaggttcaaggacaagacgtttcagagatatttggggaagatagtacgatgttcacaagacctgactttaattgaaaagcattagctaacaaaccttcatatcttcatccaaagggatatatgccatttccttgcatgggtcaaataaactgtactttgcactcttgctaaatatgttctgcatggcacccacataaacggctgccagtaggggggtcatacccatagtggcaagcataggagtcagtggctgtccaaacaaaatcagagagaagaatccaacaccagtcagcaacagaacggtgggggtgatctttgcagccacaccccagccaannttccgtannnnnnnac

SEQ ID NO: 479 - DNA, 622 bp, Zea mays
  misc_feature (72)..(72): n is a, c, g, or t
  misc_feature (125)..(125): n is a, c, g, or t
  misc_feature (206)..(206): n is a, c, g, or t
  misc_feature (256)..(256): n is a, c, g, or t
  unsure (1)..(622): unsure at all n locations
tacaaaggttcataaaaaggtttgctgcaacttctagggcagcttataacagtacatactagcagcacaaanggtcaaggaacagcatgccagacaacgcatcttgcgcccgaacgctcgacttnctgtcaagcggctcttaccataccaaggttacacgatccatcgatgcaataccattgtaggttcttgttttgtagacgcanacgcagccgatctatatgacagacccatcgttgatggttgcattcttcangatcaccacgattccagaccttatgtagtacccttcttccgggtgatcagcctcttggatgccctgtcacagagtcgaacccatgccccatggtcacaagactagcgctggataggaattaccgaattaggatagatgagcacacaagattctgcacccatgtaggtgcgctcgctcaccttactgtttgtgatcaccacgttcttcccaatcctagcattcatgtcaatgatacagttcctgaaaataatcagaggataccatcaggtatcagtgagtgatatttttgggaactaaccggtggttccacatccatactcaccttatctttgtgttccttcctattccaactgggaccttcccagc

SEQ ID NO: 480 - DNA, 1125 bp, Zea mays
  misc_feature (934)..(934): n is a, c, g, or t
  misc_feature (942)..(942): n is a, c, g, or t
  misc_feature (1106)..(1107): n is a, c, g, or t
  misc_feature (1115)..(1122): n is a, c, g, or t
  misc_feature (1124)..(1124): n is a, c, g, or t
  unsure (1)..(1125): unsure at all n locations
cacaggatgcatatggtctaatctgctttcctttttttcccttcggaagccgagcttctaaaaatgggctagtgaagattgatcatactggacgtgtacttcaattctttgaaaaaccaaagggtgctgatttgaattctatggttagaaattccttgtgtaatccaattcttttgttttcctttctttcttgagatgaacccctcttttagttatttccatggataacctgtacttgacttattcagaaatgattttctattttgctgtagaatctgacactaaagctaatagctactgatgttgcagagagttgagaccaacttcctgagctatgctatagatgatgcacagaaatatccataccttgcatcaatgggcatttatgtcttcaagaaagatgcacttttagaccttctcaagtaatcactttcctgtgacttatttctatccaactcctagtttaccttctaacagtgtcaattcttaggtcaaaatatactcaattacatgactttggatctgaaatcctcccaagagctgtactagatcatagtgtgcaggtaagtctgatctgtctggagtatgtgttctgtaaactgtaaattcttcatgtcaaaaagttgtttttgtttccagtttccactagtttttatttaccaatgcacgatttatgtattttcgcttccatgcatcatacatactaacaatacattttacgtattgtgttaggcatgcatttttacgggctattgggaggatgttggaacaatcaaatcattctttgatgcaaacttggccctcactgagcaggtactctgtcatgtattctgtactgcatatatattacctggaattcaatgcatagaatgtgttagaccatcttagttccatcctgttttcttcaattagcttatcatttaatagttgttgnctagaatntaaacacaaatttacctaatatgtttctctcttcagccttccaagtttgatttttacgatccaaaaacacctttcttcactgcaccccgatgcttgcctccgacgcaattggacaagtgcaaggtatgtcttactgagcacaattgttacctgagcaagatttnntgtacttnnnnnnnntnc

SEQ ID NO: 481 - DNA, 733 bp, Zea mays
  misc_feature (32)..(32): n is a, c, g, or t
  misc_feature (394)..(394): n is a, c, g, or t
  misc_feature (450)..(450): n is a, c, g, or t
  misc_feature (614)..(616): n is a, c, g, or t
  misc_feature (622)..(622): n is a, c, g, or t
  misc_feature (625)..(627): n is a, c, g, or t
  misc_feature (670)..(674): n is a, c, g, or t
  misc_feature (676)..(691): n is a, c, g, or t
  misc_feature (694)..(699): n is a, c, g, or t
  misc_feature (703)..(705): n is a, c, g, or t
  misc_feature (709)..(710): n is a, c, g, or t
  misc_feature (715)..(723): n is a, c, g, or t
  misc_feature (730)..(731): n is a, c, g, or t
  unsure (1)..(733): unsure at all n locations
ctgcagcacatccatctgctcctactcaagtnggtaatcagcaatttgcgactcaagcaatggcgtatcaggtccagccacatgtacaagctcaacctccgcagcagcaacatattgttgcacatcaacaacatccacatatgcaagctttacccctacagcaaaatattcaacctaagatgcagctaaactctcaagttcagctacagcctccacatgtccagcagcaagcttacccacaatctcaggtctatcctcaacagacacatcatatgcactcccagaatactacatatgcacagcaacaaacccaaggtgctttgatgcaacctgtacatgtgtcccaccaacaaacacatgtttctcatcatcctgcaccgatgcgtcctccatngtcaggccatcagccagctttgcagcatcctcaggcccagggaattcaacatacancacaacatgaaaaacatattgggtttcatgctcagtggccaacaatgtattccaacattccttcccaagcaccaccacagggattgtctgtgcactcatctgtttcctcacaatcagttcaatcataccagcaaggaatgtcttcatcacaacagatgcattcnnnacctgntcnnncatatacacaacagcatgttactggcaatactggacaacatgnnnnnannnnnnnnnnnnnnnntannnnnnatcnnncacnnacacnnnnnnnnnagcagcnnca

SEQ ID NO: 482 - DNA, 847 bp, Zea mays
agagcaacatttgagataaatgcatatttcatctgtggaggagaacaagtcaagtacacaaaatcttgctcaggtaacaattgtgctcagtaagacatataccttgcacttgtccaattgcgtcggaggcaagcatcggggtgcagtgaagaaaggtgtttttggatcgtaaaaatcaaacttggaaggctgaagagagaaacatattaggtaaatttgtgtttaaattctagccaacaactattaaatgataagctaattgaagaaaacaggatggaactaagatggtctaacacattctatgcattgaattccaggtaatatatatgcagtacagaatacatgacagagtacctgctcagtgagggccaagtttgcatcaaagaatgatttgattgttccaacatcctcccaatagcccgtaaaaatgcatgcctaacacaatacgtaaaatgtattgttagtatgtatgatgcatggaagcgaaaatacataaatcgtgcattggtaaataaaaactagtggaaactggaaacaaaaacaactttttgacatgaagaatttacagtttacagaacacatactccagacagatcagacttacctgcacactatgatctagtacagctcttgggaggatttcagatccaaagtcatgtaattgagtatattttgacctaagaattgacactgttagaaggtaaactaggagttggatagaaataagtcacaggaaagtgattacttgagaaggtctaaaagtgcatctttcttgaagacataaatgcccattgatgcaaggtatggatatttctgtgcatcatctatagcatagctcaagaagttg

SEQ ID NO: 483 - DNA, 462 bp, Zea mays
  misc_feature (41)..(46): n is a, c, g, or t
  misc_feature (51)..(51): n is a, c, g, or t
  misc_feature (117)..(117): n is a, c, g, or t
  misc_feature (245)..(245): n is a, c, g, or t
  misc_feature (272)..(272): n is a, c, g, or t
  misc_feature (312)..(312): n is a, c, g, or t
  misc_feature (339)..(339): n is a, c, g, or t
  misc_feature (341)..(341): n is a, c, g, or t
  misc_feature (404)..(404): n is a, c, g, or t
  unsure (1)..(462): unsure at all n locations
catgatgaacagttgcaatgtctccaccttccacttaagannnnnnacaantccaacctaattaactcccttagctttagaacagtgggaactgagccagtgagccctcgagttccnttcccagccactgattccaatgtccactgaccaatcaagacaattccccaatcctaaactcctatctcccattcccttataacaatttcctacgatcgaacacacttgtaaggtcctgatctttatgngatatgttacaaaacaatcatgcagtnaaaaaaatgaaaatcatgggtacataaaacaatcacccanccacaaaatccatattaagaaatgagntnctgagaatagcaagctagcaaccaaatgatgctgataaaggcacataatgcttgatcacaggnatacctgccaatgttaggagcccatgctacagcacacactttatctcctgtatcctca

SEQ ID NO: 484 - DNA, 653 bp, Zea mays
  misc_feature (464)..(466): n is a, c, g, or t
  misc_feature (496)..(500): n is a, c, g, or t
  misc_feature (503)..(522): n is a, c, g, or t
  misc_feature (524)..(538): n is a, c, g, or t
  misc_feature (547)..(556): n is a, c, g, or t
  misc_feature (558)..(573): n is a, c, g, or t
  misc_feature (581)..(582): n is a, c, g, or t
  misc_feature (587)..(593): n is a, c, g, or t
  misc_feature (597)..(614): n is a, c, g, or t
  misc_feature (618)..(624): n is a, c, g, or t
  misc_feature (626)..(636): n is a, c, g, or t
  misc_feature (638)..(652): n is a, c, g, or t
  unsure (1)..(653): unsure at all n locations
cagtagtatgaattcatcaagggcaagggtgcagatgtcattccagcatttgtccaaagacaaacctttctttctttaaccatcaatttctagaaattcgtagtttattatcgtacgatttaagttcctagattaaccatgagaaatactttcatagcatataatttgcatgttgttaagctgtatgaacttgtaggaattgttggtcaaagatgtaaatgtttgaataaggacaatgccaaaatgacaattaaattgaaacaagagtatattataagcttaaacctatgtggccatcatggttcttaaagcggtaaggcgacgtcttatctatctaagaaccagcaagactaacatggagaggaagaaaaagaaaaaagaaaaagaaaaaaaggggtagcaggcccagcccaccatctagcccacatatcctccctgttgccctcctcctgccgatggggccnnncctgccctcgaagcagccgtcagcaccctnnnnntgnnnnnnnnnnnnnnnnnnnngnnnnnnnnnnnnnnnattcgagcnnnnnnnnnncnnnnnnnnnnnnnnnngccccganncaacnnnnnnnatcnnnnnnnnnnnnnnnnnncttnnnnnnncnnnnnnnnnnncnnnnnnnnnnnnnnng

SEQ ID NO: 485 - DNA, 634 bp, Zea mays
  misc_feature (98)..(98): n is a, c, g, or t
  misc_feature (224)..(224): n is a, c, g, or t
  misc_feature (314)..(314): n is a, c, g, or t
  misc_feature (384)..(384): n is a, c, g, or t
  misc_feature (435)..(443): n is a, c, g, or t
  misc_feature (530)..(530): n is a, c, g, or t
  unsure (1)..(634): unsure at all n locations
ccctgcagccttgtggtgctcgacgtcaggaacaactcactcaccggcagcgtacccgccggtaacgcctctatccattagtatcataatctgggtcnttcgatttttgaaagcaattaacaatgctgattgcgttgcctcttgcttggtcccaagaactggccgccaagctgcaggccggcttccagtacgggaacaacagcgacctgtgcggcgccgggctncccgcgctccgcccgtgcaccccggcggacctcatcgaccccgacaggccccagcccttcagcgctggcatcgcgccgcaggtcacgccntccgacggccgcggcaacgggcgcgtgccatctaccagggcgctcgccgcagtggtcgtcgtcgccgtgnccctccttgtagccacgggggtcggtctgttcgcgctctcgtggcgccggnnnnnnnnncagagggtcgcggggggctcgccgtcgacgatctccggcggccggtgcagcactgaggtcgtgccttccgcggcgaaggcgtcgtcngctcgcaagagcgcgtcgtcggcgctggcgagcctcgagtactccaacgcctgggacccgctggccgacgcgcggggcgggctgggtttcgtctcgcaggacgt

SEQ ID NO: 486 - DNA, 667 bp, Zea mays
  misc_feature (5)..(6): n is a, c, g, or t
  misc_feature (9)..(9): n is a, c, g, or t
  misc_feature (13)..(13): n is a, c, g, or t
  misc_feature (81)..(81): n is a, c, g, or t
  misc_feature (178)..(178): n is a, c, g, or t
  misc_feature (362)..(362): n is a, c, g, or t
  misc_feature (615)..(616): n is a, c, g, or t
  misc_feature (642)..(648): n is a, c, g, or t
  misc_feature (651)..(651): n is a, c, g, or t
  misc_feature (655)..(655): n is a, c, g, or t
  misc_feature (657)..(658): n is a, c, g, or t
  unsure (1)..(667): unsure at all n locations
tcacnnganccangtaactaattgatcagcgctatatataatggctacttataagtttgaaatgtgtttctatcattacanttttctcgtgttggggtgggatagggggagcatgataatttggggaaaatgtatgttccaaagaggataagcatacctatgttcaatattggacctncggtctgataattccttatccttatgatgaggtttatctgttccaaagaagacaatagctttctaatcaagatccatgagtacaaaaggattgtatctcattttctaatttcaggacaaccatgattttatagaaacttgaataaattatgctacctgctttagaggtttcacgagggcaaacntcaccaagctctctacgttttttaaggatttgtgcgcgcatcctgttatcaaaatcctcttcattctcgtcttcaggaaaatcatcagataatggagcattctcttgctcccttgattcaactttctttgagatcaaagcatccctgacagtttgaacagtaacctttttcatctcctcttgctccttggactgcaaaatgtgagtaagcacaatgctattcaaatttggcagagcataacaagttacagcanntaacactataattgaaaaaactgacnnnnnnnaangatncnnatcgcaccc

SEQ ID NO: 487 - DNA, 367 bp, Zea mays
aagaaactcgtctatccagaaaatctttgcagcagaacatcggtgtgctgcatgggtaaaggatcagcaagctcgaagtatctgcatttatagaagggttatcagttgtagagttcatgtaccagctatacaataacaaagggcgggttcactataccatggaagcagcgttcctgtttctcattgacaaaatgacagcatcaagaaaagcctttgcagcttcagcatcattttctgcagcctctgcaactcttgctgcttcctcagcttctgccattgctacttctgcctcggcaactgccttggcagcaaaggcagcagcctcttccctggtcatgcctttcatcttctccagttcagcaaccat

SEQ ID NO: 488 - DNA, 444 bp, Zea mays
  misc_feature (43)..(43): n is a, c, g, or t
  misc_feature (48)..(48): n is a, c, g, or t
  misc_feature (53)..(53): n is a, c, g, or t
  misc_feature (109)..(109): n is a, c, g, or t
  misc_feature (136)..(136): n is a, c, g, or t
  misc_feature (195)..(195): n is a, c, g, or t
  misc_feature (199)..(199): n is a, c, g, or t
  misc_feature (206)..(206): n is a, c, g, or t
  misc_feature (238)..(238): n is a, c, g, or t
  misc_feature (240)..(240): n is a, c, g, or t
  misc_feature (255)..(255): n is a, c, g, or t
  misc_feature (267)..(267): n is a, c, g, or t
  misc_feature (274)..(274): n is a, c, g, or t
  misc_feature (280)..(280): n is a, c, g, or t
  misc_feature (303)..(305): n is a, c, g, or t
  misc_feature (325)..(327): n is a, c, g, or t
  misc_feature (333)..(333): n is a, c, g, or t
  misc_feature (335)..(335): n is a, c, g, or t
  misc_feature (385)..(385): n is a, c, g, or t
  misc_feature (406)..(406): n is a, c, g, or t
  misc_feature (433)..(433): n is a, c, g, or t
  misc_feature (435)..(436): n is a, c, g, or t
  misc_feature (438)..(439): n is a, c, g, or t
  unsure (1)..(444): unsure at all n locations
gggggtgactgacggcatgaggaagaggaagagctgcggatangaagntgcancagctgtgaagtttgtgaagtacaaggttgaagacagctcgctgaaggactacctntcagcagctaatggcataagcagtggnagtgaggtagagaacccgcagtctgatgatgagatggaagaatcaaactgatgcatagnaacnagatcanccgctaatgcttactttggacagttgcttttngngagttccttggacanccgccttttttnggagccnggaccngtcttgtttcagctgccgcttgnnnaatgatgccgtgcagaatcnnnaagacngncccatctccagctaggcattcggatgtagtagtaaccgttagctgaccanacttgacatggagcatatgangtttgctatgggccatatcgtgctctntnntnntaatc

SEQ ID NO: 489 - DNA, 710 bp, Zea mays
  misc_feature (132)..(132): n is a, c, g, or t
  misc_feature (147)..(147): n is a, c, g, or t
  misc_feature (190)..(190): n is a, c, g, or t
  misc_feature (208)..(209): n is a, c, g, or t
  misc_feature (246)..(246): n is a, c, g, or t
  misc_feature (378)..(378): n is a, c, g, or t
  misc_feature (387)..(387): n is a, c, g, or t
  misc_feature (397)..(397): n is a, c, g, or t
  misc_feature (428)..(428): n is a, c, g, or t
  misc_feature (447)..(447): n is a, c, g, or t
  misc_feature (449)..(449): n is a, c, g, or t
  misc_feature (515)..(515): n is a, c, g, or t
  misc_feature (517)..(517): n is a, c, g, or t
  misc_feature (612)..(616): n is a, c, g, or t
  misc_feature (632)..(633): n is a, c, g, or t
  misc_feature (641)..(642): n is a, c, g, or t
  misc_feature (647)..(647): n is a, c, g, or t
  misc_feature (649)..(656): n is a, c, g, or t
  misc_feature (661)..(684): n is a, c, g, or t
  misc_feature (687)..(695): n is a, c, g, or t
  misc_feature (699)..(699): n is a, c, g, or t
  misc_feature (701)..(708): n is a, c, g, or t
  unsure (1)..(710): unsure at all n locations
ctcatgtatgcattcgatgtagttccctgaggtaaatgaccacaccctgacagaatcttcactgacagacgccagatagttgcccgcggcatcccaacatactgactgaataatctgtacgtggccctacanaaaaaacacaagccnaaattacagagtacatcgagaatagtgcagagtaaatgcaaanaacatacagtgaagttannacttagaatagccgctaagttgcatacctacacttancgcaatttaggaatgacatggacatcaaggaactgattataattcaggaaagaaacaaaatttcagcctggatggtgatgagctgatcaaatgctcattataccacaagagttctcatcataccacaataangtataaacntacactcgtntgtatgttgtatctcaataatctagtactcnctccattccaaattataananaattttgcttttctagttatattacttttactatatatctagacatagtgcgtatctaagggggtntnttattgcactagagcagtagagctaatagttagttggctaaaaaatagctagtggaattagctagataacaaatatctagctaactaatagctannnnnctaaaatagctcatanntaaactannagctngnnnnnnnngatannnnnnnnnnnnnnnnnnnnnnnnctnnnnnnnnnagtncnnnnnnnnat

SEQ ID NO: 490 - DNA, 1344 bp, Zea mays
  misc_feature (524)..(524): n is a, c, g, or t
  misc_feature (578)..(578): n is a, c, g, or t
  misc_feature (587)..(588): n is a, c, g, or t
  misc_feature (639)..(642): n is a, c, g, or t
  misc_feature (662)..(662): n is a, c, g, or t
  misc_feature (664)..(669): n is a, c, g, or t
  misc_feature (673)..(677): n is a, c, g, or t
  misc_feature (679)..(778): n is a, c, g, or t
  misc_feature (793)..(795): n is a, c, g, or t
  misc_feature (805)..(817): n is a, c, g, or t
  misc_feature (1279)..(1281): n is a, c, g, or t
  misc_feature (1284)..(1286): n is a, c, g, or t
  misc_feature (1306)..(1307): n is a, c, g, or t
  misc_feature (1312)..(1313): n is a, c, g, or t
  misc_feature (1326)..(1337): n is a, c, g, or t
  misc_feature (1340)..(1342): n is a, c, g, or t
  unsure (1)..(1344): unsure at all n locations
ccagtgtaggtgaagctttctcaagttctgtcttcaagccctgtacaaagaaaatgtgaatgattaaaatatttcatcttatgaaaattcagaaggaagtctgtagaaactaatgtgactggacatgacaagcaatattctattttactctccctttcccctcaatacccacatggaagaaacaagaacagcacaaaatgcaacagcacccaactccttcaatgcatcaataacaaaaaaaaggttcttggaggtgattgatcgtgtcactttcattttaggaaagaacggaggaggctggttatatttgcaggttattaactagattgtctaacttcacttttacaaatttaaagtttcagatatatatacctgaaaaaacatgctataaaacttgggatacaacatagcatgggagcggcacaacattacttacatgcttaattccctcatgaagatggttcacatcttgagatatatgacacttaagggaatatactgattctgtctccatgctctcctcnccactttctgcacagtggaccctggaaaaaaagcattcatcaacaaatatcacnagttcacgnngatcatttcatatttgttacatacttacatgaacacccaatctaccagttnnnntgacaaataccaaatggaancnnnnnnactnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaacagaacaggnnnagaatacggnnnnnnnnnnnnncaattactcgatgacagcactaaaacaatcataagttcataacaggctttacaggcacagacgcccatgtatttgatatgcagacatcaaaagtataggaggtgcagtttgtatcatttaccgttctggacatgcattgggaaataatgtttattgtattcagctaacaattaggtaaaggccaattataaacataaaataagatactgttgtatgttggaactgtctgtgtactgtttaagatatataaaacaggataactagccttatgtcagtatagcagggttctttttggtgtgtgtctaattagcacatggcacatctcacataatcttttgctggtttgaactggacctgtaccatatttttcttctataattatatgctattctatgcacctctcctgcctgttcgagtaaaaaataaacagtcgcaccaaactacaattgtagaacaaaaagnnncannnacatatatagggcatataanncaagnnaggggggacagannnnnnnnnnnngannnat

SEQ ID NO: 491 - DNA, 1349 bp, Zea mays
cccccgtcgtcggagctggaggccatacggtggggcagcgccaagctgcagggcgctcgcgacgagatggaggatgaggtcttgctccgcccgggctccctcctcgatggcttctccttcgccgccgtcttggatggacacgccggcttctccgccgtccagttcctcagggatgagctgtacaaggagtgcgcagctgcgttggacggcggcgcggtgctcagcactaagaatctcgacgctatcacggcctccatccagcgtgccttcgccgctgtcgacgccaagctctccacctggctcgagcaaacggacaaggacgactctggtgcgacggccactgtcatgtttctcaggagcgatgtgcttgttgtctcgcacattggggactcttgcttggtgatatcacgtggtggaagatctgaagctttgacgggctctcatcgaccatatgggaacaacaaaacgtcccttgaagaggtcaagaggatcagagcagcaggtggatggattgttgatgggcgcatatgtggagacatatctgtatctcgtgcttttggggacataagatttaagacacaaaagaatgaaatgctggtgaaaggagttaaacaaggaaggtggactgataagttcatctcacgaatacaatttaaagatgatatagtaatctcgtcacctgatgtatctctggtagagcttggaccagatgttgaatttgttctgttagcaactgatggtctttgggattacataaaaagctctgaagctgtagcttttgtcagagatcaactccgtcagcatggtgatgtccagttggcctgcgaggcacttggtcaaaaagctctggatcaacggtcccaagacaatattagcatagtgatagctgacttggggaggacaaactggaaggcgttgcccgatgaaagaccgaacttgttcttggaactaagtcaagcagtcgcgactgtaggggttgtctcaataggaatttgggtctcgtcgttccttgggttacagtagaactagctactccgtccggatgtgtatattacctactgagtttacatctttctgctagcagtagcagctggaaaatatatgtatattcgtatatatagtgtgaattgatagggtaatctgttgtgtaatactgagtgaacgtgtgaagtactgatgaagatcgtgtagttgagctcctggtgagtcatgagtcatgacagctgagtggcttttgagtaatcctcatgtcaaaaaaaaccaagcaaaagaagaacacgaaaaagatcttctcatcagttgctaattgctacaaagccataaacaaatgaaggagtattgaataatgg

SEQ ID NO: 492 - DNA, 449 bp, Zea mays
tgaagcatgcgctcatgacggcacccctactacagatgtctgacttcaccaagctcttcgttgtcgattgagacatcaagagttggatttggcgtcgtgctccatcaaggcgacggggtgatcatgtacttcagcagggctgcggcgccgcatcatcagaagctccttgcttatgagcatgagagctcattggtagccctacccgtgggctcacaccttccgagtccgaacggatcacttcagtcttaagttcctcctcgactagcggctttccatgattccttagcggacgtgggtaagcaagctctttgggtatgatttttctgtggaataccgtcgaagtaagcttaatggcgctggcatgctgcagatgagatgaggcagaattggttgtttggagtttgtcagctccggcctttgagctgttcgacacgctgcatgtcgaggca

SEQ ID NO: 493 - DNA, 652 bp, Zea mays
  misc_feature (46)..(46): n is a, c, g, or t
  misc_feature (539)..(539): n is a, c, g, or t
  misc_feature (555)..(555): n is a, c, g, or t
  misc_feature (557)..(557): n is a, c, g, or t
  misc_feature (579)..(579): n is a, c, g, or t
  misc_feature (608)..(612): n is a, c, g, or t
  misc_feature (618)..(620): n is a, c, g, or t
  misc_feature (624)..(626): n is a, c, g, or t
  misc_feature (629)..(630): n is a, c, g, or t
  misc_feature (639)..(641): n is a, c, g, or t
  misc_feature (643)..(644): n is a, c, g, or t
  misc_feature (647)..(648): n is a, c, g, or t
  unsure (1)..(652): unsure at all n locations
gttccagcagcttcatttccttgtgcccaagctatagggaaatgcnctgatttttggccagcatttctgttcttgtcacctgaactctcttcgaaggaaccatagtctatgttctgaagtgccgttggaatctggatacccccaacaagtacttctttgctttccatgtctaggtcaatcttttcccttgggtttgtcacatccagcccaatgtatggagtgtagaatccagcttcaagtgagccctcacctacccatgaacgaaaatcattcatcggaggtggtatcttggtaaagaacacttccgcaaagtttgctgcaatgctcttgcggtagggattgtccttcttgtcataatggtatctaaagttttcatatgttgtctgcaaaatatgtaggtactaactagtatcaatttaaaagattggaggctgtaagtattaatacgattagattatgcattgcaatttatggaaactttgcactactttgcattctggagatcgtaatcaacttaatattttggataacatattgtncataaccttcataagnangtttatacatgtactgcatgtngtaaaaatacatgttccccttttattttnnnnntgtatnnngctnnngcnntctttgcannncnntgnnactt

SEQ ID NO: 494 - DNA, 352 bp, Zea mays
  misc_feature (14)..(14): n is a, c, g, or t
  misc_feature (321)..(321): n is a, c, g, or t
  misc_feature (334)..(334): n is a, c, g, or t
  unsure (1)..(352): unsure at all n locations
cggtacttgcacangaaagggaggagcacccatgtcactggcctgcacggttttctcaagcctaggcctcttttcaatctggaagcccggcggttccccggagagttctccagaagccggtccactgttcttggaagatagcgaggcgccatgctcggcaacaaaagatgagaaaatggagctcagaacctgcacaggtgccgacaaagatgccagcttgtctgccattgctgctgccgttctcttcggctcatctcccactgcactgactgtaggggcaagcgaggttgctggattcagtgattgcaactgaggagacgncagccttactccngaaccctgtatcatagca

SEQ ID NO: 495 - DNA, 533 bp, Zea mays
  misc_feature (229)..(229): n is a, c, g, or t
  misc_feature (295)..(295): n is a, c, g, or t
  misc_feature (337)..(337): n is a, c, g, or t
  misc_feature (412)..(412): n is a, c, g, or t
  misc_feature (414)..(418): n is a, c, g, or t
  misc_feature (427)..(432): n is a, c, g, or t
  misc_feature (436)..(441): n is a, c, g, or t
  misc_feature (447)..(463): n is a, c, g, or t
  misc_feature (481)..(486): n is a, c, g, or t
  misc_feature (488)..(498): n is a, c, g, or t
  misc_feature (506)..(520): n is a, c, g, or t
  misc_feature (522)..(529): n is a, c, g, or t
  unsure (1)..(533): unsure at all n locations
gacattgctgtccgagaaatcgaggctggcgcaggaaaactcgacgtatgcccgtgaaaaccgcttcctgcgtgagattgtcgacttccatcagttcaccacccacgacgttgtctcattggatgacggcgacatggaaggcaccgaaccagaagaagacgacgacaacgacaacggcctcatatgtgctgagaacgtgctgcctgcggttgaagaaaatccagtagangaagaacactgccctgtcccctccaagctagaatctccagtggccagcctgggcgagccatcatcntcccccaggtccagcgattgtcacagtgcctcgaagccagangcgtcagcgtctgatgtagcttgatgatgcatgcgacattggtgactttgccatcttgtttggggtttcagcctnannnnncgcggactnnnnnncccnnnnnntataannnnnnnnnnnnnnnnncccattcaacgtaactcnnnnnnannnnnnnnnnngggctatnnnnnnnnnnnnnnntnnnnnnnnagat

SEQ ID NO: 496 - DNA, 655 bp, Zea mays
  misc_feature (528)..(529): n is a, c, g, or t
  misc_feature (548)..(548): n is a, c, g, or t
  misc_feature (567)..(567): n is a, c, g, or t
  misc_feature (577)..(583): n is a, c, g, or t
  misc_feature (585)..(586): n is a, c, g, or t
  misc_feature (596)..(597): n is a, c, g, or t
  misc_feature (601)..(603): n is a, c, g, or t
  misc_feature (611)..(617): n is a, c, g, or t
  misc_feature (619)..(619): n is a, c, g, or t
  misc_feature (621)..(636): n is a, c, g, or t
  misc_feature (639)..(643): n is a, c, g, or t
  misc_feature (645)..(652): n is a, c, g, or t
  unsure (1)..(655): unsure at all n locations
tgagcgatgaggatggtgcgctggtggacgcgctcaaccgtcgagctgctgtttctgccgccgcccccagcttcttcgaggggttcgcgctccacgggatccgcgtggagagcatccgcccaggccacatcctctgctccttcacggtccccgcacgcctcacctccggcagcgatcacatagcccccggcgccgtggtggccctggtggacgagatcggctccgccgcctccgtgtccgacggccaccacctcaaggtctccgtcgacatgtccgtcaacttcgttgacctcgacgccgccgcgcccggggacgccctccgcatcaccgccagggcgctcggccacaagggcgcctactccggcacgcacgtcatcgtcgccaacgccgccacggggcaggtggtcgccgaggggaggcactcgctcttcggcaagatgaagatcaggagcaacatctgaattggagcatgtgtgcacacagtgctgtgtttgttgtcgtgtgctctgcttctcgactccttgtcannaatgtaatggcagcagctngcttcttcagtaaaaaatnaaaaaaaaannnnnnnannattatgtttnntcannntcatgatnnnnnnnancnnnnnnnnnnnnnnnncannnnnannnnnnnngat

SEQ ID NO: 497 - DNA, 566 bp, Zea mays
  misc_feature (80)..(82): n is a, c, g, or t
  misc_feature (100)..(100): n is a, c, g, or t
  misc_feature (198)..(198): n is a, c, g, or t
  misc_feature (249)..(249): n is a, c, g, or t
  misc_feature (284)..(284): n is a, c, g, or t
  misc_feature (500)..(502): n is a, c, g, or t
  misc_feature (510)..(512): n is a, c, g, or t
  misc_feature (520)..(526): n is a, c, g, or t
  misc_feature (530)..(534): n is a, c, g, or t
  misc_feature (537)..(541): n is a, c, g, or t
  misc_feature (548)..(563): n is a, c, g, or t
  unsure (1)..(566): unsure at all n locations
atggcgtacaagttctccaacctggccatctgcaaggccgtcggcggcggcgggaggaagaaggtgcacatcgtggactnnngcgaccactactacgggntccagtggccgtcgttgctgggctactggggtagcctggaggctgggccgcccgaggtgaggatcaccgccatcgacttccccgagcccgggttccgnccggatgctcggctccaggcgaccgggcggcggctcacatgcttcgctcgncggcatggcgtccccttgaggttccacggcatcgnggccaggtgggacgcggtttcggtggacgagctgagcatcgagcgcgacgaggtgctcgtcgtgaacggcctgttcagtctcggtaggatgcaggagcaggagcaggacgacgtggatagggatagccggccgagccctagggacacagtcctcggtaacgtccggaagatgcggcccgacgtgttcgtcctgtgcgtggagaacagctcgtacgnnncgcccttnnncgtgacgnnnnnnngggnnnnnctnnnnnactactnnnnnnnnnnnnnnnngat

SEQ ID NO: 498 - DNA, 757 bp, Zea mays
  misc_feature (152)..(153): n is a, c, g, or t
  misc_feature (155)..(155): n is a, c, g, or t
  misc_feature (355)..(384): n is a, c, g, or t
  misc_feature (437)..(437): n is a, c, g, or t
  misc_feature (467)..(467): n is a, c, g, or t
  misc_feature (512)..(520): n is a, c, g, or t
  misc_feature (578)..(579): n is a, c, g, or t
  misc_feature (596)..(596): n is a, c, g, or t
  misc_feature (598)..(598): n is a, c, g, or t
  misc_feature (601)..(601): n is a, c, g, or t
  misc_feature (606)..(612): n is a, c, g, or t
  misc_feature (621)..(621): n is a, c, g, or t
  misc_feature (624)..(625): n is a, c, g, or t
  misc_feature (629)..(629): n is a, c, g, or t
  misc_feature (634)..(634): n is a, c, g, or t
  misc_feature (639)..(642): n is a, c, g, or t
  misc_feature (654)..(659): n is a, c, g, or t
  misc_feature (662)..(662): n is a, c, g, or t
  misc_feature (665)..(667): n is a, c, g, or t
  misc_feature (669)..(678): n is a, c, g, or t
  misc_feature (683)..(683): n is a, c, g, or t
  misc_feature (685)..(689): n is a, c, g, or t
  misc_feature (692)..(693): n is a, c, g, or t
  misc_feature (695)..(695): n is a, c, g, or t
  misc_feature (698)..(699): n is a, c, g, or t
  misc_feature (703)..(703): n is a, c, g, or t
  misc_feature (708)..(714): n is a, c, g, or t
  misc_feature (716)..(720): n is a, c, g, or t
  misc_feature (722)..(725): n is a, c, g, or t
  misc_feature (731)..(756): n is a, c, g, or t
  unsure (1)..(757): unsure at all n locations
gggtcacccgcagatcaaggagtactggtgttggccttctgatggccgtgcgagggtccacatacatgatcaggcaatatataaaggagccaggattcaatgcagcgaatgagatggcatccatcaaccaggagataagacagattggtagnntnatggtcatatcaggcaatatattggagccgccggaatggattctgcaagcccaagacctggcctgtgatgtgcaggatttcacggatatctacacatggctgcaaagcaaatcgcggaggcgtgcccttgcacatataggctacatagcgcagctgaaggatcggatcagcagccttcgagagtggcaacagagaggagnnnnnnnnnnnnnnnnnnnnnnnnnnnnnngtgctgctgccttgtccttctcgcggcgatcatgcgggccttgcgcccctgangatgtgctagttggcattgatcagcccagnaaagaactttcggacctcattttcgaaagggaggatgttgtgcannnnnnnnnacagaagcccagggtggtctctgtcgttgggtatagtggcattggcaagacagccctnncaagagcagtctactangnccntagtnnnnnnnctgcctttnacnncgtngcttnggttnnnncatctgagtgcnnnnnnggntgnnncnnnnnnnnnnagatntnnnnncanntnaannacgnacaannnnnnnannnnncnnnngtcgtnnnnnnnnnnnnnnnnnnnnnnnnnnt

SEQ ID NO: 499 - DNA, 377 bp, Zea mays
  misc_feature (1)..(22): n is a, c, g, or t
  misc_feature (24)..(31): n is a, c, g, or t
  misc_feature (33)..(34): n is a, c, g, or t
  misc_feature (36)..(52): n is a, c, g, or t
  misc_feature (55)..(56): n is a, c, g, or t
  misc_feature (58)..(59): n is a, c, g, or t
  misc_feature (61)..(66): n is a, c, g, or t
  misc_feature (200)..(200): n is a, c, g, or t
  misc_feature (293)..(293): n is a, c, g, or t
  misc_feature (369)..(375): n is a, c, g, or t
  unsure (1)..(377): unsure at all n locations
nnnnnnnnnnnnnnnnnnnnnnannnnnnnntnnannnnnnnnnnnnnnnnnaannannannnnnncgatggaatcgattaccatgaggagggacttgacgttatccatggtgaagccgtactcctcgtatctggagaggaagatgtcgatgaagtcgtccgactccttctccttgtcgccggacagcttcctcatctcnacgtgctcgtggatcacctcctccagcagggagtcccagcgcttgaggtggcgcgtgaccttccagcacacgagcctgaagagcaggtccgtnagcggccaccgcgggatgtagtactccaggttgaaccccaccaggaggtccacgttggtcatggtcatctccctgnnnnnnntg

SEQ ID NO: 500 - DNA, 549 bp, Zea mays
  misc_feature (2)..(21): n is a, c, g, or t
  misc_feature (96)..(96): n is a, c, g, or t
  misc_feature (498)..(498): n is a, c, g, or t
  misc_feature (506)..(510): n is a, c, g, or t
  misc_feature (514)..(542): n is a, c, g, or t
  misc_feature (544)..(545): n is a, c, g, or t
  misc_feature (548)..(548): n is a, c, g, or t
  unsure (1)..(549): unsure at all n locations
gnnnnnnnnnnnnnnnnnnnncaccaccgcgcgctctgacgccagcttcgccacgcggtccattgccagcttttccggtggctatatattactgtntgtccgaaactagctagcactcacagcctctttgggtgtgtgaggtacgtagatgacttggaacttggaaggtgaatgatgtgtgtggttgctgctcgaaatgttgagcggcttcttgacttttataggctggaaaagactcgcacgtactaaaacgtaaacttagtgtggattattgagatttccttggcttattcacttcttgcacagttgcacggtgcctacttgcgctgtggaataacattctttaatttagactttttctctttgtaggtatgatgattccgggacttgctaagcacatgttaaaaagcacccctccccctcccttctcctttgcaagacgcacacgtatattatattacgaattaaacttcaaattaaaatctttgactttacctnataatttnnnnnattnnnnnnnnnnnnnnnnnnnnnnnnnnnnntnngtna

SEQ ID NO: 501 - DNA, 685 bp, Zea mays
gctctgtacagaagagtgaaccaaatcgaagccctgcggtgctactccaagcctgaaggctcaatgtttatgatggttagtcagagatacacaaaaattcagtatttgaaactttgttacttcccaacataaaggtgttggtattcacaaaaccctgcaggttgagatcaacacttcaattctacatggcgtcgccaacgacatggactttgctcgtgagttgatcaaagaagaatgtgtcctggttctacctggtacagctcactcactccatttgttgcgatattattttatccaacctttaacaggtgcattggtttctctggctgctgagaactgaatgttagtaataggttgacttgacattccagtacaagattcttcatgctggcatgattttaatctactctaaaattgatctgtagtaacagatccaatatcctttttgtttcttgttattttacaggttctgtcattgggttgaagaactgggttaggatatttttcggagcacctgttagtttaatactagaagcttgcgacaggattgagatgttctgccgaaggaggacgctcaagcaaaacaactgaagagctgaaaatgttttgaaaccaggaagtagggtttttgttagcccagtaacatatatatacagcttcgatttattttccaatgcacattctg

SEQ ID NO: 502 - DNA, 1018 bp, Zea mays
caccattctgtttatattgttagtagctctcttttgctttcttgaagctacgtggtgaacatcgtcgtcctctactttctgagattaaataacgattacaagctgtcagcgtggcttatgtactgtacatgcatgtgttcttcgtacttgcatcaaagtgacattaatacgatatacgtttgagtcgattcttcatttggagtcagcagggaagagaaaaaaaagctcataaaggaagatgccagtagtcgcagcgttctaagacacaagacgtgcgtgatcactggatgcttgttttgaagagctttttacgccttgagctagcctcacaggaggacagcacacggttcgtctgcctaccttagtttgtgccaccaggtcgttttcatggtacacactacacacagctagctagcccacagcataatcatataaattatatatacatcggcctaaccttttccatcgtaatggaaccacagtacagcaggaacagatgcaaccgcactttctttgatctccctctcccctgcgcgcgcgctgagcctcacaggacgagagcacacggttcctctgttcttgttcgtttcaaactccatgctagctacacagagccctcaacaatcatatataaattacagactttattagctgaagaatccgatcccatttgtcttgaacagcactgaacactcatatagtaactagctatggccaatcacacgttgacagcaagaacatatgctccgatccgtgcagagcagtcatggagagacacgaacaatggacagcaaaacgcaaccccctgcctaatgaacacatttatttattcgttccaagagtatagttcaccatgcatgttcctgtcaaatccaaagcaacaccaccaccattcttcacatgacgctacacgccgccgacgggtcgtcgtcgctgaacgtccggcagcccctgtaggccccgcacggcgctggcaacgggcggacggtcgtgccgtacagcctgccgcagcagtagc

SEQ ID NO: 503 - DNA, 506 bp, Zea mays
  misc_feature (201)..(201): n is a, c, g, or t
  misc_feature (278)..(278): n is a, c, g, or t
  misc_feature (290)..(290): n is a, c, g, or t
  misc_feature (316)..(316): n is a, c, g, or t
  misc_feature (327)..(327): n is a, c, g, or t
  misc_feature (332)..(332): n is a, c, g, or t
  misc_feature (335)..(335): n is a, c, g, or t
  misc_feature (342)..(342): n is a, c, g, or t
  misc_feature (352)..(352): n is a, c, g, or t
  misc_feature (440)..(440): n is a, c, g, or t
  misc_feature (450)..(451): n is a, c, g, or t
  misc_feature (459)..(459): n is a, c, g, or t
  misc_feature (465)..(469): n is a, c, g, or t
  misc_feature (481)..(481): n is a, c, g, or t
  misc_feature (484)..(498): n is a, c, g, or t
  misc_feature (500)..(505): n is a, c, g, or t
  unsure (1)..(506): unsure at all n locations
acatccacggcagtgtcaaaggttcttgtgaacaacaattcgaagggctcctcaggatacagctctttccaaactttttctgactcaagtgtcgactttgtttgagtggacgactcaacgttgttattgttcagtattctgccatacactttcttgcagtcccttatgtactgaacctgaaagatatgtgctcgaataatnaggtccctcggttctctgaatagcatcatcaacaagggtacaggcatacaagatgcttatagatcatttccaaatanagtcatcatatntatcagtaaaaaccatgcagttggcngtctgattcancgttnagntcattcntaacacaccnaagggtacgtgaattacagatgatcatggtgagtagggtgtgtaccgggttaaggcgatggcagtgccatatccactcacaatcaagnggaacaaccnntggaccanctacannnnnacccttagtgtnctnnnnnnnnnnnnnnngnnnnnnt

SEQ ID NO: 504 - DNA, 817 bp, Zea mays
  misc_feature (254)..(254): n is a, c, g, or t
  misc_feature (537)..(540): n is a, c, g, or t
  misc_feature (764)..(764): n is a, c, g, or t
  misc_feature (815)..(815): n is a, c, g, or t
  unsure (1)..(817): unsure at all n locations
gatgtcatgatgcatttatgcttcttaattcttgacaaaatagaaatgaacaagtgattggctcgatttaccaaaacaagacagtctgttaatgcatcatgtgtaattaaagcaccatcaacccccaattatattgacatattgttgtcagtactttatcagcattgcttcacagcctttaactgtaaaacaaaaccctcatccaattgtacaaactctatgttaagtatgtaatgttaagtgacccttatgtntacaatgttacaccataaaggttctaggacatgaataagaggactgaattagttcccaatcagttctttgatatgaagtcatgtattactaggccactatgttacttacatagttctgttagtatcttctatgttaggaggccttttgtatgtaatgtaagaggttgttcaattagcacctccagtgacaagctgaaattaaaagatcgtatctcttcaattatcatagttctgactgcgtggacacaagacaaagaaatcggtggatagaacagcaccatcnnnnacccattaaatgccacaaaaatcaggttcatggtcccacaattcaactgacaacagtaatatttctaaactacagatttagtttgtatggtcatgctgtcaaacattggttacaactttacatttctcaagtccccgcaataacgacatctatttactcagttccctactaattaagactgaaccatcttcagatgaaatagtagcttgtgaataaatttggangcattgtcaagtggcaacaatctcacctgaaacatcatgtttctttcctcnaa

SEQ ID NO: 505 - DNA, 525 bp, Zea mays
  misc_feature (5)..(6): n is a, c, g, or t
  misc_feature (8)..(8): n is a, c, g, or t
  misc_feature (10)..(10): n is a, c, g, or t
  misc_feature (12)..(50): n is a, c, g, or t
  misc_feature (154)..(154): n is a, c, g, or t
  misc_feature (156)..(156): n is a, c, g, or t
  misc_feature (167)..(167): n is a, c, g, or t
  misc_feature (169)..(169): n is a, c, g, or t
  misc_feature (191)..(191): n is a, c, g, or t
  misc_feature (243)..(243): n is a, c, g, or t
  misc_feature (414)..(414): n is a, c, g, or t
  unsure (1)..(525): unsure at all n locations
ttganntngncnnnnnnnnnnnnnnnnnnnnnnnnnnnnnnnnnnnnnnnccgctaatccaggccgcggagtgccgcatatgccaggaggaagatagcgtgaagaacctcgagaaaccgtgtgcttgcagcggcagtctcaaggtttacacccnanttaattaaatnantgcatgccattcttatctccanagagctttaagcttcacagttgttcatgaggtgtacatgcaattaaaatttncgcttttggttctctttttgcattaacatgtgtctgtcatttccattgacatgttttcttgattaaaaagcacaaaacgatcacatggttccattcataaccatgacactcttgtaggaaacacactcatctctccccaatcactactgcatcatatcctgtaatattgcntgtctatatctgctctgttgggagagctccaagttattcattcacttctctatgcagtagagttgcactatttttctaccacattgctaacaggaatggaccagttgattc

SEQ ID NO: 506 - DNA, 628 bp, Zea mays
  misc_feature (15)..(15): n is a, c, g, or t
  misc_feature (19)..(19): n is a, c, g, or t
  misc_feature (121)..(121): n is a, c, g, or t
  misc_feature (243)..(246): n is a, c, g, or t
  misc_feature (274)..(274): n is a, c, g, or t
  misc_feature (279)..(279): n is a, c, g, or t
  misc_feature (373)..(373): n is a, c, g, or t
  misc_feature (413)..(413): n is a, c, g, or t
  misc_feature (592)..(592): n is a, c, g, or t
  misc_feature (617)..(617): n is a, c, g, or t
  unsure (1)..(628): unsure at all n locations
cagcagtataatttnaggnttttagctctagtagtactcatccattcataattctggtttatatatgttcaatattccacatgtttatgagaggacaactaaacgtattttgttgaaatgnagtcatcggtcaacaacataggtacatgttctttctatcagatggcattatgaaagcatatttcatagttgtaagaatgtgaagtccctgttgtattgcataggatggttacatatatatannnngactcggaaccctaaccctaataggtcngcagnccaacagtggtgccagtctaactacatatataagaacacacacacactccaacaatagttgcgtccatggtaagcagtttcatgtttttatcanggttcaggatgcttcacatagtggttctaaatcctgaatntgttattaactgatttttagttacttctccttttgagcagctctgaggcatcctagtttgtatccgttttcagttaaccgctttgtacgaaaacaagcattaatcctatcttgatttcctttttaacttgtaatttatgttttttggtcaattgtcatgaataggcatttggctgggcntatgttaacaattggcacaacacangggagcagggg

SEQ ID NO: 507 - DNA, 710 bp, Zea mays
  misc_feature (182)..(182): n is a, c, g, or t
  misc_feature (409)..(409): n is a, c, g, or t
  misc_feature (467)..(467): n is a, c, g, or t
  misc_feature (484)..(484): n is a, c, g, or t
  misc_feature (488)..(488): n is a, c, g, or t
  misc_feature (517)..(517): n is a, c, g, or t
  misc_feature (526)..(526): n is a, c, g, or t
  unsure (1)..(710): unsure at all n locations
ctttcttgagtattttatacttgagtcaatttagttcacagcttggaggcttgagttgttgagctttagcctgactggttggcccatcaaccaaactaccaaaaaagagtgaaaattgaatagacttggccaaccctatatgcccaaagaaagtaagatacaacggccaaaatacaactacncatagaaatagtgattggcttattgtcagtaaaaaaacatttgttgggtggggtacattctccagtttcaaagtaatagctcttccagcaaaaatacattttggtttagatttagaaacaaaattaaatagtctatcaataacttctaaaaatattcagcttcagagaatgaaaattatgtgtagatccattcatggtcttagtgatgatgtgatataactttgcanagtaaataataccaatttaacagtaaaactctgaaagtttttttaaacaaattagtantcttcatcttgttaggnctgntgcagtggtgagagctgtctcattgagtntctagatcntgggttttttcttgaacacgcaagagagttacgtatcatttcattatgaaaggaaaaaaatacacagggaaaggaatccctaaacaccaagacaaactaacaatgtgacgaaccgaccagccgtcctgagaacaggtgacaacgcaacaacactagcactagcctctgttcgagacccttacaa

SEQ ID NO: 508 - DNA, 763 bp, Zea mays
  misc_feature (515)..(515): n is a, c, g, or t
  misc_feature (662)..(666): n is a, c, g, or t
  misc_feature (675)..(677): n is a, c, g, or t
  misc_feature (684)..(695): n is a, c, g, or t
  misc_feature (699)..(720): n is a, c, g, or t
  misc_feature (724)..(728): n is a, c, g, or t
  misc_feature (730)..(739): n is a, c, g, or t
  misc_feature (745)..(759): n is a, c, g, or t
  misc_feature (761)..(762): n is a, c, g, or t
  unsure (1)..(763): unsure at all n locations
gcagatgatatgggaggtggacttctggcgctcggcgctttatctcagcgtcttcgcgcttctggtggagcaggaggctggcatggcatggggatgtcgtgtttgcctcgtcaaagcccaagacaactgtcgtggtttccatataggttgtgccaaaggatactcacgctcggcgatgctctccctgttcgccggagctcgtgcggtcgccccggaccacgcgcattgtggtaaaatccagggcactcccaccaaacttattgtccgccccgtgaagagccgaacatctttgtaggtatgttgtggctcccgtgaacttttagttatttgacgagtggaagggaaaagggtagggcatgagaggagggaagatgggggttttggggttcttctctactcaaaagaatatctgcacatgtttggtgttgtaataaattgtgataactaaacctagtggcagctacgtggggtattccaaaaacaattgtccccaaaatagtaagaacaagagcacnagttgaactagacatcttagattatctccagcagcttactcatccacatcactcatttcaaactccactctgtaaatagtgcagtttacatgcaaaaccgtgttttgcacgatttgctggccatagccttagtacatgtgttatgannnnngtcacctannnacgtctnnnnnnnnnnnntggnnnnnnnnnnnnnnnnnnnnnnggcnnnnngnnnnnnnnnntttgcnnnnnnnnnnnnnnnannc

SEQ ID NO: 509 - DNA, 652 bp, Zea mays
  misc_feature (103)..(103): n is a, c, g, or t
  misc_feature (107)..(107): n is a, c, g, or t
  misc_feature (534)..(534): n is a, c, g, or t
  misc_feature (543)..(543): n is a, c, g, or t
  misc_feature (569)..(570): n is a, c, g, or t
  misc_feature (572)..(574): n is a, c, g, or t
  misc_feature (576)..(577): n is a, c, g, or t
  misc_feature (579)..(583): n is a, c, g, or t
  misc_feature (590)..(592): n is a, c, g, or t
  misc_feature (599)..(599): n is a, c, g, or t
  misc_feature (603)..(603): n is a, c, g, or t
  misc_feature (606)..(608): n is a, c, g, or t
  misc_feature (614)..(617): n is a, c, g, or t
  misc_feature (620)..(621): n is a, c, g, or t
  misc_feature (627)..(628): n is a, c, g, or t
  misc_feature (630)..(630): n is a, c, g, or t
  misc_feature (643)..(646): n is a, c, g, or t
  misc_feature (651)..(651): n is a, c, g, or t
  unsure (1)..(652): unsure at all n locations
tcggctgatgcagaaacaaataattaggttacatatgcatgactacaaatatactactcatcaaaatgataacatgaacagataccaaacttattgtacgcanaaanaaaaaaaatagttgaactttgcttacctggatacaaggtattccaatttctttgaaacaaaagaagctgcttcttcaggcgtaccaataaaatctaaatcagaaacttcaacggctaatgctagtgccgctgctatggctattgctggagcaccacggacaaccatgtctcttattgcattcctgggtaatatttaggggtcagtataaaacaagcattatccagtggtatttataactagttacatttcaatggttgcagtaggcctatcaccatgggagcatataacacaattgctggaaattatgtgattgttttttcttctctagtgtgatcaaggtcaatccagaataccgaaatttctactgatcacagattcaatatgaatatatgatagccttgtacacctctattgatgaaattaccnaaaaaaaantgccactgttttacttgaacacaaanntnnncnncnnnnntaaccannnagcagcnaaanctnnnttagannnnagnnacacgnngnaaattaacagttnnnncaagnc

SEQ ID NO: 510 - DNA, 408 bp, Zea mays
  misc_feature (4)..(4): n is a, c, g, or t
  misc_feature (15)..(15): n is a, c, g, or t
  misc_feature (25)..(25): n is a, c, g, or t
  misc_feature (131)..(131): n is a, c, g, or t
  misc_feature (168)..(168): n is a, c, g, or t
  misc_feature (200)..(200): n is a, c, g, or t
  misc_feature (388)..(388): n is a, c, g, or t
  unsure (1)..(408): unsure at all n locations
atangcatggactgntatatactangctttatctgaagatttgtgttcatggagttgggtaggaggccatcgtggagataccacaggcgccgacgcccatctgtagctgcatgaaaccgttctcaccccancctgtgccccaggagttcttgaggatccagtactggnttccctggtcatcggcgccgtagccgatcgcngtcactgcatggttcatgtccgtgccacagccatccccgtcgtatatgccaccctggtaaaactggaaaggactcgatccgccgtcgacgccaacagacaccggctggttggcgactgcgttggcgagcgcgttctcgtcgccgctgggcaggtcctggaagccgctgatggtggcggctggctggangttttggcacgtcccttgga

SEQ ID NO: 511 - DNA, 408 bp, Zea mays; identical to SEQ ID NO: 510
  misc_feature (4)..(4): n is a, c, g, or t
  misc_feature (15)..(15): n is a, c, g, or t
  misc_feature (25)..(25): n is a, c, g, or t
  misc_feature (131)..(131): n is a, c, g, or t
  misc_feature (168)..(168): n is a, c, g, or t
  misc_feature (200)..(200): n is a, c, g, or t
  misc_feature (388)..(388): n is a, c, g, or t
  unsure (1)..(408): unsure at all n locations

SEQ ID NO: 512 - DNA, 417 bp, Zea mays
  misc_feature (67)..(72): n is a, c, g, or t
  misc_feature (91)..(99): n is a, c, g, or t
  unsure (1)..(417): unsure at all n locations
acgcccctggtcacgacatggggcaataccgagcgtcgcaacgggagccctagacacgccactaccnnnnnncgtgaagaacaaccaccgnnnnnnnnntcgcagcaggtcgcgcagatccatcaggacctgatggccacacagcttggggtgaccgacgacgctgtcgtcgtcgtctcacatgccgagaacctcgaggtcaaagtttctggatctgagtctaatatggttgttcccaacataggggtcaccatgcacggcagcaacgaggtcacagagaacagcggccgcagcagccatgacaataattctgtgatcatcatcatcgacgatgacaatgacgacgacgcaaatcctgccatcaccgtcgcagcagggtctcctggagctcctggtctagctcctgatgcagcggca

SEQ ID NO: 513 - DNA, 536 bp, Zea mays
  misc_feature (264)..(264): n is a, c, g, or t
  misc_feature (374)..(374): n is a, c, g, or t
  misc_feature (430)..(430): n is a, c, g, or t
  misc_feature (445)..(527): n is a, c, g, or t
  unsure (1)..(536): unsure at all n locations
gaggaatcattaactggaggatcatttgatgaaggaaatatggtcaagaacattgaagcctgtgactggttaaccagtgctataaagaacctagaagcgtccaacatagacccaatctatgtaaagttgcgtgctgtaggttccctctcttcgtacaaatagcatttgttttcgtattgaaggtttacatacctgagatttttgttaatattacaaatcagtggaccttaacttagatacacagttagatgcatagtttttcgngatgcatagtttttactatgcacttagatatacactatatctagatacacaacaaaagcaatgtatatagaaaaccaaaatgtcttataatttgaaatggcatgagtatntattagtatgctgctctggtagaacttgaaggatttttttatgacatggaaaggtngatatattgagtagnnnnnnnnnnnnnnnnnnnnnnnnnnnnnnnnnnnnnnnnnnnnnnnnnnnnnnnnnnnnnnnnnnnnnnnnnnnnnnnnnnntaaacgaca

SEQ ID NO: 514 - DNA, 795 bp, Zea mays
catgcctgcagaaattcacagtgtagaagcacacctgtgtcttggcacttgatccaagactccccccatacatatattccgtggttccttacaagcacagcagttgcctttgggtatgctgcaatctgataaataattctgtatcaaaggcctacatacatctaaaatattcatggaaactctgttatcaagattcaagaatagtattgtaactatagataaaccaaatagtattgtaaaaacaaccaattgggctgataaatttatgatgactaaaccactacagtaactataatcagaggctctgaacaacatcaatcaatataccagcaatttccccatttatcatcaaataatttaaaattaatgtgctagagacatgataatccttgaatcagcttgttataacttataaggctatccctagaggcatgttgtgcagggaatttgtgttcaaatccttatgctcctcaaacccattgcttttttgtactggtctattttggaccaaacttcttcttaatttaatgatgtgcatatctcttgcgcgtccgagaagaaaaaaagatgattgaaagataggagtttgatagcataccgcctcacttagggagtcagtgagctcatactcataaggggtattctcaataataggaatgaccaattcatcatggtagccatgaccctttgattcctttgatcattttccatgtgggtcacctgcaataagatcagcatcagtatctagtcaaataaggattttcttaccacaattatctagcatacaaatataca

SEQ ID NO: 515 - DNA, 640 bp, Zea mays
  misc_feature (2)..(4): n is a, c, g, or t
  misc_feature (507)..(511): n is a, c, g, or t
  unsure (1)..(640): unsure at all n locations
annntactaatatatcagaaaaatatttggtgtaatggcattatgatttcttggccatatgggaaatgagaaatgacttgcaagttttgatgtttacacacaaatttgggcaggaacgcatagttttattgtaaaagtgttaaacaagatgatttggtattcacataagctttactcctgaaatgtcatcacaggactaaaacagcatctactttgcaagaccttcccctgttcgaagtgccatgttcagattcgctagtgaaagaaaaaaccctgacgacctaattttagccccaaacaaagaatcgaaaggagatcacagttacctggccggtccaagaagcagaacacggggcggtcgaatccggggcactcacgccgaccaatcccgtcaggaagctccccgtcggcggcaagcagagcatggaagtcaactacggctgacagatcagcgccacctccctctccgctagacggcctgcatcctgacctggacctggacctggnnnnncccttgacgttgagtgtcttgtaaagcttgtactgtttctccgcacgccggaaagccgtgcgctccgcagctgtggggtcggaagtgccgtacatcgccggcagcgcccgagtgagttctcgccgccgt

SEQ ID NO: 516 - DNA, 395 bp, Zea mays
  misc_feature (232)..(232): n is a, c, g, or t
  misc_feature (284)..(307): n is a, c, g, or t
  unsure (1)..(395): unsure at all n locations
cctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtnaactccaagatcctatccaaggtaatcgagtactgcaacaagcacgtacatnnnnnnnnnnnnnnnnnnnnnnnntcgaaggccggttccgacgacgtgggtgccgcctccgccaacagcaccgccgcctccggtgaggacctcaagaactgggatgcggact

SEQ ID NO: 517 - DNA, 679 bp, Zea mays
  misc_feature (157)..(157): n is a, c, g, or t
  misc_feature (161)..(161): n is a, c, g, or t
  misc_feature (467)..(469): n is a, c, g, or t
  misc_feature (502)..(503): n is a, c, g, or t
  misc_feature (555)..(561): n is a, c, g, or t
  misc_feature (569)..(580): n is a, c, g, or t
  misc_feature (589)..(591): n is a, c, g, or t
  misc_feature (596)..(600): n is a, c, g, or t
  misc_feature (607)..(609): n is a, c, g, or t
  misc_feature (611)..(623): n is a, c, g, or t
  misc_feature (627)..(627): n is a, c, g, or t
  misc_feature (629)..(645): n is a, c, g, or t
  misc_feature (651)..(677): n is a, c, g, or t
  unsure (1)..(679): unsure at all n locations
caaagcagttgcaagaactgtcttaccaaagagaagagagcttaaaacgctgggagcatagtattggttctaaagaggattgccttcacaggttggtacttaatctctgatttaagtgttaggaaacatgatgtcttaggggatgtgcttttattgncttncttcaatttttttctatgcatattgacagtcattttgtgcacaaaccgtggtgctcttttgtgaatttataagcactgtccgtttagttggacctgttatctcatatcactaattcacttataaagaacagtctataggtaaatccttagcctggaagctacttgcgtttccaggaatagtattgcaccattagcaactgcttagataaattaagtaaatgcttaaaatggaggtggaagcgaccacaaggacacactatttagctgctgatgttgcaactaaagactctgattcagacaagactnnnctactggaaatttagaaaaaaaatggatgaagnntacacaacttattgcatagttgtcttttgtatgaacatgttataaattatcnnnnnnntaaatttnnnnnnnnnnnncaaatgaannnatgannnnngtggatnnntnnnnnnnnnnnnntatncnnnnnnnnnnnnnnnnntatatnnnnnnnnnnnnnnnnnnnnnnnnnnntg

SEQ ID NO: 518 - DNA, 387 bp, Zea mays
  misc_feature (1)..(19): n is a, c, g, or t
  misc_feature (69)..(73): n is a, c, g, or t
  misc_feature (101)..(101): n is a, c, g, or t
  misc_feature (313)..(314): n is a, c, g, or t
  misc_feature (318)..(318): n is a, c, g, or t
  misc_feature (334)..(336): n is a, c, g, or t
  unsure (1)..(387): unsure at all n locations
nnnnnnnnnnnnnnnnnnnttgcccccgcaatgtgtacatcctgaccagcagaagtgatccactacagnnnnnaagaacaaagctagagtgagaagaacanggaggaactaagctaactcccggcctaattatgggatgggttggacctgctcttgggcgtcgtcttcaagctctcgaacaacaccgtcgccggtgccttgaaggcttggctgaacccgcccacaggcgtcgagcaggagtcacggcattgcgtcgacagaagccttctgctcctcactctcacaacagacggttgcagctgcaacggctggnncganggcgatgaagaagaannngaagaagggccacagagcaggacaaagaagagaaggatcagcagagctgag

SEQ ID NO: 519 - DNA, 822 bp, Zea mays
  misc_feature (13)..(17): n is a, c, g, or t
  misc_feature (87)..(87): n is a, c, g, or t
  misc_feature (118)..(118): n is a, c, g, or t
  misc_feature (232)..(232): n is a, c, g, or t
  misc_feature (235)..(235): n is a, c, g, or t
  misc_feature (284)..(284): n is a, c, g, or t
  misc_feature (319)..(319): n is a, c, g, or t
  misc_feature (323)..(323): n is a, c, g, or t
  misc_feature (361)..(361): n is a, c, g, or t
  misc_feature (392)..(392): n is a, c, g, or t
  misc_feature (465)..(465): n is a, c, g, or t
  misc_feature (500)..(501): n is a, c, g, or t
  misc_feature (506)..(557): n is a, c, g, or t
  misc_feature (559)..(559): n is a, c, g, or t
  misc_feature (561)..(562): n is a, c, g, or t
  misc_feature (564)..(565): n is a, c, g, or t
  misc_feature (567)..(569): n is a, c, g, or t
  misc_feature (571)..(571): n is a, c, g, or t
  misc_feature (573)..(578): n is a, c, g, or t
  unsure (1)..(822): unsure at all n locations
tgcctgcaggcannnnnccagtttcaaggaaatcggccagagaataaggtctcggtctctcgatcttatcgaacatacaagcgtttnttttttaaaaaaaaagcagcttatttcagtnaatagaacttgattgttaagaacgccgacagatcgcaccgcgcggattgttttccattgctgtgaactggctctgctttggttgttttgttccagtgagcacgcggagaagtanggntacggcatcgaccccttcgtggggcacggcgttgggaggatgttccacngcgagcccatcatatggcatacctgtaagtgattnaaanaaaaaacgcataccgtttcctggtcgctgtggttaatncagtccaagcaaagcacgcacggcctgaatncacgtccgtacggcattgttgttggcagacgattacgagcccgggttcatggtcgcaggccagacattcaccntaggtaagaaagagcagctaaagcgtccgtcccannggacnnnnnnnnnnnnnnnnnnnnnnnnnnnnnnnnnnnnnnnnnnnnnnnnnnnntnanntnntnnnancnnnnnnggaatggtcacgtgctgagaacccgtgcgatgcagagccgacgctgtcgatggggagcacgcagtgcgtggtgtgggacgacgggtggacggccgtggcggcggacggcagcctcagcgcgcagttcgagcacaccgtgctggtcaccggcgacggcgcggaggtcctgaccgggttcccgtagctgcctgcacgcatcacgtgagcggtgagcctgggtgggccactgcgtcggcgagggacg

SEQ ID NO: 520 - DNA, 708 bp, Zea mays
agggtagagtggcctagggctgtcacatttaatgatctcgcgtcgagtgggcaaatccttcacagaacaaccaaacggatcaaattcaacagagaacaattattgtcggtggtaagttgacgaacagaaatcaaatctttaataagagatggagagaatcagatgtcatgtgactagaggcaccggtgtcaaagcgtcaatgtgtcattcttgctgggacggctattggagatgggcaaattgaaagttggcggcgagagcctgcctgatcccagaccggagcaggcgaaggcgagtcggtgtagccaggcgaagggacccccacacacacacgcgcgcgcgcgcgctgccctgccaactgaccggaaggcccagcgatggaggcgtgtggttgctaggtcagtcaaggaggcaggcaaggtgcagaaggcagacgttggccaggccacatgtaaatggccctcgtacagggattgtagttgtagaccacgaagttggaagagtgcctagggccaatgtcgtcgctgctattgttgtcggaattctttttgctgctcttgcacctcttgccgcgcgtcgtgaccagagtcacccttgactgctgcgtgcggagcgttgtggctgctgctgcgaagggcgagaggtggccagggggaagcagacatcttggagccacccgcctcgcctatcccaaagaggacagcaaga

SEQ ID NO: 521 - DNA, 722 bp, Zea mays
  misc_feature (6)..(7): n is a, c, g, or t
  misc_feature (12)..(12): n is a, c, g, or t
  misc_feature (596)..(598): n is a, c, g, or t
  misc_feature (617)..(617): n is a, c, g, or t
  misc_feature (631)..(634): n is a, c, g, or t
  misc_feature (639)..(640): n is a, c, g, or t
  misc_feature (649)..(651): n is a, c, g, or t
  misc_feature (665)..(670): n is a, c, g, or t
  misc_feature (675)..(675): n is a, c, g, or t
  misc_feature (691)..(695): n is a, c, g, or t
  misc_feature (700)..(703): n is a, c, g, or t
  misc_feature (705)..(709): n is a, c, g, or t
  misc_feature (719)..(721): n is a, c, g, or t
  unsure (1)..(722): unsure at all n locations
tgcagnnacctnttcccggtggagtccgacgcctgcctggagcctcggctggggatggagtttgagtccggtgaggctgccaagaccttctacattgcctatgctggccgtgttggtttctccgttcgcattgcccggtcacgcaagtctaagtgcagtgagtccataatcatgctaagatttgtgtgctcaagggaagggttcagtaaggagaaacgtgtggtcacagctgggaagaagacgaggaagcgccctgcctccatcagggagggttgcaatgccatgctcgaagtgctccgcagaggtgatagcaagtggattgtcaccaagcttgtcaaggagcacaatcatgaggtcgggttgcccagtcgagtgcagtatattgccatcgagagtgatactgtggttgacccttacattggtatggaattcgagtcccttgagtctgccaagacattctactactcgtatgccagccgtgtgggatttgaagctcgtgtacgccagtcccgcaagtcacaggatgagtcactcaagatgctgaagcttgtgtgctcaaggcatcggtaccattctggacgggagagcaatggagnnnataccaagagagtacgtgngatggacccctcgnnnnatggnngtgatgcannntttgagataattcnnnnnngaaangacacctggacagtcnnnnnactcnnnntnnnnnatacccatgnnnt

SEQ ID NO: 522 - DNA, 1003 bp, Zea mays
  misc_feature (79)..(79): n is a, c, g, or t
  unsure (1)..(1003): unsure at all n locations
tccatgctcgagaagcagtgggagctccccttcgaggacgacatcatttccactgacgacgagcaggacgacagggttngcaaggccacggtggtggcggcgcggtcgggcgtctcggcgcggcagcggcggatgagcggccggcggcggggagctggtcggaagagcgttgccatcagcccggagctgatgcagagccggaaccgcatctacctcaggggcaccgtcagcaaggacctcctcacgcacaagcaggtcatccagctctccaggaagatcaaggacggcatctggcttcagcaccaaagatcaaagtaacgtttcaatccaagatgcatgcccatcaattgcacaacttcagataattagcatttgaaagctgacatcgtatctcccaaaaccattcaaaatgctctataggctgaaatgtattaaacaaaagtccatgtagtataactgtgatcaaaattgcacgctgaagattgtgggcgcctaatgaaattacattccctatctgattctgattccccgctgcccccaattttgagttcaggctgaaggagaaactggggaacgagccatcatacaagcagctggcacagtcactgcggatatcagctcctgaactgcgcgcaaggatgcgcgagtcgtttctcgcgagggagatgctgacaatgagcaacatccgtctggtcatatccattgcccacaagtatgataacctcggtgtcgacttggcagaccttattcaggtgatggcatgagatgtgtcgaccgattgaaatgtatctgggtattccagctgtttaatttgtttgttttacactgcaaattactcattactttacctcaaacgttgaaatggaatgtgttcatccacgttgcagggtggtctgatagggctactccgagggatcgaaaaatttgatgcatcgaggggattcaggatttccacctatgtgtattggtggattcgtcaggttatttgagcagattttcttgt

SEQ ID NO: 523 - DNA, 532 bp, Zea mays
  misc_feature (3)..(9): n is a, c, g, or t
  misc_feature (195)..(196): n is a, c, g, or t
  misc_feature (431)..(431): n is a, c, g, or t
  misc_feature (451)..(451): n is a, c, g, or t
  misc_feature (454)..(456): n is a, c, g, or t
  misc_feature (476)..(476): n is a, c, g, or t
  unsure (1)..(532): unsure at all n locations
ccnnnnnnntccagcctccgccgccgcctacccaagggcgcttcgaaatcgttatcaacaacgacaacatccgaacgctcgacctatcgccagtcgaagcagcactcggcgacttgagctccttgacaccaggttcacagccagcatacgcccatgccattagctttaacttgcattcaccgaccttattacagnnaaatttatgtgcattgttcagctgcttcaagaaccctgctggaccagaccgtcgggttcaccatcagctacgagagggaggacgagtacgacacgcgggagctgtcggagttccccgacatacggctgtggttcgtgaggctcgacgccgcgtacccttggttcccggtcgtgctcgactggagagccggcgagcttgccagatacgccgcgatgctcgtccctcaccaggtgantatttctcagaaaagcttanatnnngcacatacaagtcttgtgcngttgtgcgccctttgaaaactatacatgcggtgtacgaaacggtttttgtggatgg

SEQ ID NO: 524 - DNA, 1131 bp, Zea mays
  misc_feature (2)..(2): n is a, c, g, or t
  misc_feature (6)..(6): n is a, c, g, or t
  misc_feature (132)..(132): n is a, c, g, or t
  misc_feature (170)..(170): n is a, c, g, or t
  misc_feature (179)..(179): n is a, c, g, or t
  misc_feature (936)..(936): n is a, c, g, or t
  misc_feature (971)..(971): n is a, c, g, or t
  misc_feature (1052)..(1052): n is a, c, g, or t
  misc_feature (1087)..(1087): n is a, c, g, or t
  unsure (1)..(1131): unsure at all n locations
tncagngcttcttgatatactgctctctcagcgtaatctaagaccctattttcaggattaaggcgactgtgtgtctcaaagcccttagcaacttcactgttattagaattggttgcctcaaacgttgaaggnagtaccctatgtgagctagaacctccatatacaatganatcatctgncatataaaaaggggtaaagattaatcttactacagaaaatctacaccattttccaatgcttgtgttattgatcaaattacatcatgtgatgctagcatacccaccatcatcatccactttatgggtattaagtgtactagaacttcctcttgccattattgaagatgaaggctgcaaatttccattggcaatatttgtccccattctgttttcaccaatatttggtgactttttggtggataaaggcagtgggagcttgcgtgtttcgctagcaacaattggatgcatagattttgatgtgttgccatttgaaaaggatgatggaaggaccctcttgttattgtcatttgcatctgctgtagaactgttgtgcttttccactacgctatcaattctactggaagtagaatggcccggtcgcatagccatataaggatttgcatggggatgaatcctgtccactgaaccaaatgtataacgactactctcagcatgtctaccattcgtaagggatgctggaagaatcctgtattgaccattgttgttctcagtaggcttagtcgatggtggagcaggagcgctcctttgccaatcttcatcctcaaaattgattattcgtccttcagcattttgatcaagccttgcgattgcagacgctggctggtcgtcatcatcgaatattgagccaattgagtcatcatcactatccgaaataataatggcagagttttcattcatattgccagcaagcacgtgnactgtatatgtgttcttagaactttgtttttcttngcatgactaaaccattcatgaaccaatggtttgctttctatcttacagaaataaacagcacttccttttttcagatgatcnccaagctaaaagagagagcacaccacccatctcanagtagcactcacagttattcgagttaccctcactgtgggagtaa

SEQ ID NO: 525 - DNA, 814 bp, Zea mays
ttcattttaaataattgatcactagggtcaatacaacaatttaagctgcgatagagttttatgcacactgaaacagttggatttgttgcctgtgctctaggtcacaagttcaataaagtagagggtaacaaagcagcattattgaacctttcaaaagaagacaaggtttgaacaatttatagcattttctctgccttatttctaattgttttcaaggttagtatgagatgcatattttttttctcaggctggaggctacatatttgagtttgacaatgttggtaaccgtgaccaatgtcgagactttgtaggtaatgttcgttttgtagttggtcgatgccaacagaacagttaaatattttctttggaagatatctaatgataggcatgaaatgaaagtaagtgaagtacttagctgtttctctcataaacttatctcctatgcaagtcacttgcaatataagaatttgactaggtacctcattccagccagacctagcatttggcttgctacataagataagatagatcactataacgtaacggtgactattttataaggaatataataaaattctggattgagggttgtttgctgtgccaagttcgatatggcaccgactcacatgaaagctaccatattgtgttccgtgcatctattaccgagtaagatgcatccataacttaatacatcctcctcgcagctagggttttaggcaaacattaagggatagtgcctcctagaccaactgtggctcctgaaaacttagttgcttctgctgctctggaacaactcagtggccgcagaagtgga

SEQ ID NO: 526 - DNA, 430 bp, Zea mays
cagggcacttatgtctccacgaactccccaaaaatgtcgaggcacccatcccagaagcccctctctcttgtttcccagtatccacctttgtagcaatacgtcccgtcctcggtgtcttgctcgaaccaccgggatttccagccattgtcttgaagtttagtagactgcaatgagacagagaacatgaagaaacaacatgtatggattgtgatctatgaagcgagagcggataccattctttgccgtcgttccaacctcagcttctctgcattcgctttctcgtattcaccattctctaggtggcgctggtctggtctcagccgtgaatcagtaggtggaagtttctcctgaatccaggaatggccaagcaattaaggacaaaaacttagttaccaaacacttttatgtggcaatccacatgtagatccat

SEQ ID NO: 527 - DNA, 650 bp, Zea mays
  misc_feature (6)..(6): n is a, c, g, or t
  misc_feature (59)..(59): n is a, c, g, or t
  misc_feature (268)..(268): n is a, c, g, or t
  misc_feature (399)..(399): n is a, c, g, or t
  misc_feature (402)..(402): n is a, c, g, or t
  misc_feature (452)..(453): n is a, c, g, or t
  misc_feature (510)..(510): n is a, c, g, or t
  misc_feature (512)..(512): n is a, c, g, or t
  misc_feature (541)..(542): n is a, c, g, or t
  misc_feature (544)..(553): n is a, c, g, or t
  misc_feature (560)..(571): n is a, c, g, or t
  misc_feature (573)..(575): n is a, c, g, or t
  misc_feature (582)..(583): n is a, c, g, or t
  misc_feature (588)..(589): n is a, c, g, or t
  misc_feature (596)..(597): n is a, c, g, or t
  misc_feature (613)..(649): n is a, c, g, or t
  unsure (1)..(650): unsure at all n locations
tagtantccgggtcgatgtaccccaccgtgccggccgtggcggacgccggcgacgcggnggcgcccgtgccgccgctggccagggacagcccgaagtcggacaccttggccgtccagtcgccgtcgagcaggatgttggagggcttcacgtcgcggtgtatgatggctggcacggcgtagcaatgcaggtactccacgccgcgcgccgcgtccagcgccacccggagccgcgcctcccacgacgcgaacagcggcgagtacccgccgncgtcgttgcgccgcccgctgccgtggaggtggtcgtggagcgcgccgtggggcatgaactcgaacaccaggatgcgctcgccgcgctcctcgcagaaacccagcagctgcaccaggttgcggtggttcacncgngacagcagccgcagctccgcacggaacgcgcgctccgcgtcgaagcggcnncgccgccgcccaccgctgccgctgcgctctgcgcgcttgatcgccacctcgcgcccntnggggagcctggcgcggtacaccgacccgnngnnnnnnnnnncgatctnnnnnnnnnnnnannngccgtcnntgacnngcgacanntcacgaagcgtgaacnnnnnnnnnnnnnnnnnnnnnnnnnnnnnnnnnnnnna

SEQ ID NO: 528 - DNA, 953 bp, Zea mays
  misc_feature (1)..(3): n is a, c, g, or t
  misc_feature (8)..(8): n is a, c, g, or t
  misc_feature (14)..(20): n is a, c, g, or t
  misc_feature (30)..(30): n is a, c, g, or t
  misc_feature (351)..(351): n is a, c, g, or t
  misc_feature (405)..(405): n is a, c, g, or t
  misc_feature (428)..(428): n is a, c, g, or t
  misc_feature (491)..(491): n is a, c, g, or t
  misc_feature (525)..(525): n is a, c, g, or t
  misc_feature (549)..(549): n is a, c, g, or t
  misc_feature (600)..(600): n is a, c, g, or t
  misc_feature (603)..(604): n is a, c, g, or t
  misc_feature (647)..(647): n is a, c, g, or t
  misc_feature (731)..(731): n is a, c, g, or t
  misc_feature (867)..(867): n is a, c, g, or t
  misc_feature (903)..(903): n is a, c, g, or t
  misc_feature (925)..(927): n is a, c, g, or t
  unsure (1)..(953): unsure at all n locations
nnngcctncagggnnnnnnngttgaaaggntgccacaggttatgtacagaagaccgcacaccaggttgacgccaggaacccatgtgcgcaaaatgtcatgccttgcaccgcaccaggatagatttcatacccatccatatgtcccaacacagagaagcaggagcagagccaccggaagaaccagccagatgatgtatgattggaagcctcccttctgcattggtgctctcacgtgtggctcgagacaactctcctgcttgacatccttgttgccttcctcagaagtcttccgcaacctcagaacagatttggcttctggagaagtcatttcagcaccttcagttcaacaanatatttaactagtttagcaaaaacagaagtcatcacaagagacacaatatacanaagttccaaagcatattaccatnttcagggatgttcttttgctcatcatcatggatattaccaggtagatcatcagcacttccagngaggtttgtactcgcatcctcttcaatctgacanaacataaaaaaggtcagatggtancatttactaaaatagatcacccagggccaggatcaatgaagatttaagaanaanncactgcaaaatagtagcagtacactaacagaactagtatctanggaatatcctagataccgatcatcactagcataaaaaacagatgtaaatttagcttctgggtaacaaaaagaacaatcacctcngctttttctgctttgtgctgacttcctggttcgtctataatgcagcttgatgaatcatcagtactaggacgctggcctttgttaaggcctgactgtagccgcagcctttgcatagcagttccctgttgagtgaatnaactctctgagcttgatcttggagcagggtgatggnttctaataacaatccctgttgnnncagcctcatccccatcagaagccaca

SEQ ID NO: 529 - DNA, 636 bp, Zea mays
  misc_feature (52)..(52): n is a, c, g, or t
  misc_feature (432)..(432): n is a, c, g, or t
  misc_feature (508)..(512): n is a, c, g, or t
  misc_feature (522)..(528): n is a, c, g, or t
  misc_feature (530)..(530): n is a, c, g, or t
  misc_feature (532)..(532): n is a, c, g, or t
  misc_feature (537)..(543): n is a, c, g, or t
  misc_feature (549)..(555): n is a, c, g, or t
  misc_feature (557)..(557): n is a, c, g, or t
  misc_feature (565)..(582): n is a, c, g, or t
  misc_feature (584)..(584): n is a, c, g, or t
  misc_feature (586)..(588): n is a, c, g, or t
  misc_feature (591)..(598): n is a, c, g, or t
  misc_feature (604)..(607): n is a, c, g, or t
  misc_feature (621)..(623): n is a, c, g, or t
  misc_feature (626)..(626): n is a, c, g, or t
  misc_feature (628)..(633): n is a, c, g, or t
  misc_feature (635)..(635): n is a, c, g, or t
  unsure (1)..(636): unsure at all n locations
atgaataatcaaacactgctgcatgctattatttgtaaacatagtttatacncaacagatcagggaaaatggtacctttctccaggtatcgggcactcagggactggagctccttttccaatatttattgtaatatcacttggtagaatgcggcgcttaagtttccccatctaaaacaatgtagcaaaaagcctaaaaggagggcattcacttgaaactaaaaatcatgtttattttacatgatattaaatttgcacctttggatgttctccacgtcccctgaacaagccaggcggttctactctgaaatttccgacctggaacaaataaagaattaaatcaagttgaaatgtaggcaaaaacgatattgaaatagtagagcacggaaatagaagcttatatgctagtacaacaatgaggccatgtgaacanttatttgttactgatgaaacgtttatcctacatcatcacaacagtcttcgcacctggtgcaagaatcttaacatgnnnnnacaataattnnnnnnntntnaaagnnnnnnngatctnnnnnnncngcagaaannnnnnnnnnnnnnnnnncnannnatnnnnnnnnacattnnnnaactcacatattannnatntnnnnnnana

SEQ ID NO: 530 - DNA, 419 bp, Zea mays
  misc_feature (124)..(124): n is a, c, g, or t
  misc_feature (173)..(173): n is a, c, g, or t
  misc_feature (179)..(180): n is a, c, g, or t
  misc_feature (188)..(188): n is a, c, g, or t
  misc_feature (252)..(254): n is a, c, g, or t
  misc_feature (259)..(259): n is a, c, g, or t
  unsure (1)..(419): unsure at all n locations
ggtgatgttgttgcatagaggattttcttatggaaccaacactggcaggcacattgcccacctgccctgaaccaagaagccgttgccagccgtacgtacgaggacgattgcagttgcagggaanatcaggcgacaggttctcatggatccagcaaatcatctgaattacaaanaaaaanncagaatanatgcacactgcaagtcaagtcaacgtaaacacgggagtgcttcgtgtattatccaaaaagaagnnncaaancgtcttccgcgcagcattgtgagcctgccaggcaaatcacattgctattgctctcaacgccgttgttaaacattgggaggtggccagatcttcccaaagagctcctcaacgcggcgtgcttggttcacgtacccctctagccctgaagcaagcagttctt

SEQ ID NO: 531 - DNA, 255 bp, Zea mays
agaagttctgaatcaagaccactggctgaaaaacgtcacgaacagctttctgatgacggcaaggttaggagaggcacacagaccaacggtaggatcaaagacgactgggttaccaggaacggggagtttcttggcatttttgtttgcaatcacttctgcaagcctgcccaggggttactttctcctgttatcgcaccgaaagcgcggcacgacgacggcagcctggacctgattctcgtccatggaagcggcagg

SEQ ID NO: 532 - DNA, 705 bp, Zea mays
  misc_feature (21)..(21): n is a, c, g, or t
  misc_feature (598)..(599): n is a, c, g, or t
  misc_feature (626)..(630): n is a, c, g, or t
  misc_feature (635)..(636): n is a, c, g, or t
  misc_feature (638)..(645): n is a, c, g, or t
  misc_feature (653)..(659): n is a, c, g, or t
  misc_feature (661)..(681): n is a, c, g, or t
  misc_feature (684)..(689): n is a, c, g, or t
  misc_feature (693)..(704): n is a, c, g, or t
  unsure (1)..(705): unsure at all n locations
gcagcacatgcaccttttttnctatgtgctaaacaaagcatatttgatcagaaataaactaggtcacattttggatgaaacatactgtttcacatctggtaatccataaagtgaaaaacagcactactgttggttaatctcataatcctttctcagttttagtgtcagaaaataaaaccattagatagttcgacatacccaattaccagtagtcaccacaagagcagaccccgagtttaaagtggtggaacctgctaccatccctaacaatgatttccctcttggtaactcttgacacaaacttaattaaattgtggcagtcactgcacaaacgatggctttgactgatcctcaagggagtctgtggggctgtgctgataagaccaaaagcaattgccagtctctcactgtggtaagctcttgatatcttttgctcgtcaggatgaatatcagggagcaattcattctcctcagcaacaaagccagcttctcgtacctccttcattaatgtatccagcctcctgtatatttcagcactttgtggatgcaaagtatctttaaagaaaaacctgtgatccgttttcttgactgtgatccnnctacaggcattaccaatatataaaccnnnnntcttnnannnnnnnnctaccttnnnnnnncnnnnnnnnnnnnnnnnnnnnncannnnnnttgnnnnnnnnnnnnt

SEQ ID NO: 533 - DNA, 519 bp, Zea mays
  misc_feature (240)..(241): n is a, c, g, or t
  misc_feature (415)..(416): n is a, c, g, or t
  misc_feature (436)..(436): n is a, c, g, or t
  unsure (1)..(519): unsure at all n locations
ctgaagaatacccatttcaaaagccaaatgttagactaaccccacctccaatgctacatattacagaataaccttaagcttttgtaggaaaaacttggcaaggtacagttttcacctgctgctccatcttgagatggaccatcagcttgtgcttcatcatcatcgtcgtcctctggtggcaaggactgagctgcaacaacagaatgattgctgtttgcagctttgtcttctttaatcagnntctcctgcaaacgaaaaatggatgtcaattagtatgaaataaaaaatacagcaaaccaaggatcaagcatgagaaatgtgccatataagaatccacgatttatacaataacagttgctatcacttgttcaagtcttctaatcatttcactttcaaaccgaattctgaaaaaaanngtacccacttcatctagtcnaaagcgtttagtgacaattattaggacaattttcgccattacttagaagtgacttcagataaagcacaaatgaaacatggaac

SEQ ID NO: 534 - DNA, 359 bp, Zea mays
acagaatcatcattctgtgagccaaaccagtaactattttacatgaataaacacaaatccaaaaaaattacttggcaagctgcgaagtttgattcgaagtgaataggaattaggatgtttatagtcacagttaaccaacgaactactagtaggtgctactacagagatgccaagtatcactaatcaaggagttacacaatctcttccgataaccaaggatgcatccggaaggtgcaaatattgagcacgatattgctaccagcgagccatgtttgaggttcgaggagggtcatgctgtccactgcccaccagcaccatatgcagcagcaccaccaccaggctgtggcgagacccctttt

SEQ ID NO: 535 - DNA, 652 bp, Zea mays
  misc_feature (86)..(86): n is a, c, g, or t
  misc_feature (104)..(111): n is a, c, g, or t
  misc_feature (156)..(156): n is a, c, g, or t
  misc_feature (159)..(163): n is a, c, g, or t
  misc_feature (314)..(316): n is a, c, g, or t
  misc_feature (404)..(404): n is a, c, g, or t
  misc_feature (434)..(434): n is a, c, g, or t
  misc_feature (482)..(483): n is a, c, g, or t
  misc_feature (522)..(540): n is a, c, g, or t
  misc_feature (542)..(571): n is a, c, g, or t
  misc_feature (579)..(579): n is a, c, g, or t
  misc_feature (582)..(591): n is a, c, g, or t
  misc_feature (593)..(593): n is a, c, g, or t
  misc_feature (595)..(595): n is a, c, g, or t
  misc_feature (597)..(607): n is a, c, g, or t
  misc_feature (621)..(622): n is a, c, g, or t
  misc_feature (626)..(633): n is a, c, g, or t
  misc_feature (635)..(635): n is a, c, g, or t
  misc_feature (637)..(651): n is a, c, g, or t
  unsure (1)..(652): unsure at all n locations
cttgctcctcctctgaccaccctcccggcctcccctcgctcaccatgaagatgaaatgaagctcttgtactgtaaggttcactcantgacggtatagtccccannnnnnnntgcgtagcagcggtagtaaaaccatccatcatgcccagtgggganggnnnnntgtacagaatacagatacagactggatccgtttacgtatagattacgacgaccaaaacaggctgttcatcgtttgttccatgaacattgtttctctcacttctgtaccgtatgtgtgtactatggattcatagatctttcatgatgatgannnggaggaggaggggacgacaataggagccggcggcacggagtcctccagcggccagcactcccagtcgccgctcttgttctgcgacagngagaagtgcttgggcgtccacacctccccnctgtcgttcctctccttggcgaacctcctcgccgtgtcctccacccgnngcttcgcctgctgggctgtctcccagtccttcttcaggnnnnnnnnnnnnnnnnnnncnnnnnnnnnnnnnnnnnnnnnnnnnnnnnngccctgtnaannnnnnnnnnanangnnnnnnnnnnngatccatgacatgnnatgnnnnnnnncnannnnnnnnnnnnnnna

SEQ ID NO: 536 - DNA, 626 bp, Zea mays
  misc_feature (87)..(87): n is a, c, g, or t
  misc_feature (186)..(186): n is a, c, g, or t
  misc_feature (297)..(297): n is a, c, g, or t
  misc_feature (354)..(354): n is a, c, g, or t
  misc_feature (531)..(531): n is a, c, g, or t
  misc_feature (573)..(574): n is a, c, g, or t
  misc_feature (585)..(585): n is a, c, g, or t
  misc_feature (607)..(608): n is a, c, g, or t
  misc_feature (611)..(621): n is a, c, g, or t
  unsure (1)..(626): unsure at all n locations
ttctcatacctctgcatcccgttcgccgacctccatgcactacacggcgtgcagaaccatttacctctcgggacagaactgcgcggnggatccatgcagtaagtgtggtaagcttcgtcacagccatcacacaacactattttctcgtcgtccttgttcttgaagcagcgtctgcacaggcaagangggcagtaccagcattttagattcctctgcttctcacttgcaatctggctttctttcaggcacagggcatgatagaacttgaaagaacagtagccatgcccgcataccacnaacttcttgttctcatcttcacacgtgccacaaagcttgcacaagtttgctagagcngttatcgagaggtctggttcactgtcttcgacaatgcttgacactgagctctcctgtgttttgacggccaattcaggttcttcggcaggttcttctggcttctccacctcaagccactcgcatacatcgcagccttcatgtgctctgccatggttgttgctctttaaaggtacgtcnggttcgacgcaggtgggacagtaccattttgctggggcctcnncatcaatggcnagcttgagacatgaaacatggnncannnnnnnnnnnctatc

SEQ ID NO: 537 - DNA, 639 bp, Zea mays
  misc_feature (3)..(3): n is a, c, g, or t
  misc_feature (203)..(203): n is a, c, g, or t
  misc_feature (223)..(223): n is a, c, g, or t
  misc_feature (282)..(282): n is a, c, g, or t
  misc_feature (423)..(423): n is a, c, g, or t
  misc_feature (449)..(449): n is a, c, g, or t
  misc_feature (559)..(559): n is a, c, g, or t
  misc_feature (572)..(573): n is a, c, g, or t
  misc_feature (575)..(577): n is a, c, g, or t
  misc_feature (579)..(585): n is a, c, g, or t
  misc_feature (588)..(594): n is a, c, g, or t
  misc_feature (601)..(602): n is a, c, g, or t
  misc_feature (612)..(615): n is a, c, g, or t
  misc_feature (618)..(637): n is a, c, g, or t
  unsure (1)..(639): unsure at all n locations
aanagagccatcgcttctcttcaagaagcaatcttgggagctgcaagtgagacgcgcgttcgaaagaaacacaccgcttcctttgattttcctcgagacttctctttgcttccataaggtctttagcagctcgaatcctctccctctgtacaaacaagaaggagcattcgggaagatcaccacaggatacacttaagatgttngcgcgagaaagcacattttnaaaaaagagaatgcaatacctgatcctcttgtaattgactccgtatccgccctcttgcnctcccttcctcgtctcgtttttgcttatatagtgctaatatcctgggaagtacagtacaggtgcgttactgggggtgaatccgtgataagcaacctaatccaaggcaaggtacacacctctttctatcttcttcctcctgnccatctgcatttggttctcgttccanctgggatgtctcctagtttaggagaaatttgtagcccatgccactcagtatgcatggtatgaagttttaagggaaatatttgatacatcaaataagaagaaactaagtanattctgtctcccnntnnnannnnnnnctnnnnnnntctgctnntgcacagtannnntgnnnnnnnnnnnnnnnnnnnnac

SEQ ID NO: 538 - DNA, 716 bp, Zea mays
acagcgacgacccatcaaagattcttcccaggccgtacatttgctgacgcagaaattgggggaaggccaggtcagcgcccaaaaccagtgagtgtctacgacgctggcccggtggccccaggattctagaatcaaagcagctaaacctaaaattaactcaacgttacaaaactacaaccttctgccctataattctggaatcaaagcaagtaaacctaaaattcctgtggtaccatcgatcctgaaaattgcaaggttccaataccccgacgtcaagagcagcccaaggtatgctcaattcacccatagcattacagctgatctcgtaagactccagcttctacaggtttagcaatatgtccaaccaaggagtgcaggcacaatttccgaaccctgcaaaaggcaagacattagacaaagacaaacgatggaaaaattacaatgaatagcacatggggaagagaaacgtcaattcaactaaagcatctaccactgaaatcaaggccaataaatggttgacatgatatatcagcaatgtaaaccaaaaaaaaaaagacaaaccatgctcataaacgtaaggtcaacacaaccaaatttccagaattattgaagacaaaaaaaaagagaaggaactgaccaactgatcacgcgcttatgtcttgggaactgtaacattcaagatttttacatcttgatatggcttgtcattcttgtca

SEQ ID NO: 539 - DNA, 729 bp, Zea mays
aaccattcctcgttgtttatgatccctaaattactatttccgttgcgggtgtcgctgttatactgatgaaattagcaacagaaactcatgagtttgttctgtattagtgtgtttttgtttcacgtgaattcactagattagtctactgttgccaattggattagaacgtaaaccaagtccaatttgcagagtgcttgatggctgccgcaaggggcattaaccagcttctgaagagaattctccacaaccagtccgctgtaagtgttttggtgaactctttgtttatttgcatgttgctctaaaatgcgtccatattcaatcttatgtgttttttatttccacatatccatcttgggtacaccatcacgatatggaatctatctgactggaacctattgttcatccttaaaaacaagtcgtagggaacatgcttagcctgttagaatcgacattctcaacatggagtgatgatatatcactgccgtatgtgtttcttgtgtggctcatgcttgccagttttgtcctctcctactgtatcgatttgaaccaaataacataaattatagtagtgcctcctttcacatatatatgacgccattgattttttttcaaaactttaccactcgtcttattcgaaaatgtaaaatttcaagtcacggtcaaacaaccttaagtgataaaacaaatcacaacaaaataaatggtaactcacgattttctttgaataag

SEQ ID NO: 540 - DNA, 762 bp, Zea mays
agtcgacctgcagctcacggcgatcctgggcatgtgcatgctcattggagacggcatcctcacgccggccatctcaatcctgtcagctgttgatggactaagagggcctttcccgtcggtcagcaaacgtacgtgagcggccgatcgatttgttgattcgtggagtaatcaatcaaattcgagtgttttgtttttgcagcgactgttgaggctctgtccgcagggattctgatcggtctgttcctgctgcaaaagtacggcacgtccaaggtgagcttcatgttctcgccgatcatggcggcgtggacgttcaccaccccgatcatcggcatctacagcatctggcgctactaccctggcatcttcaagagcgtgtcgccgtactacgtggtacacttcttcgtgaccaaccggaagaggggctggcagctgctcggcggcaccgtcctgtgcatcacgggcgccgaggccatgttcgccgacctcgggcacttcaacaagcggtccatccagatcgcgttcctctctagcatctacccgtcgctggtgctcacgtacgccggccagacggcctacctgatcaaccacgtgggcgacttcggcgacgggttctacaagttcgtgccgcgccccgtgtactggccaatgttcataatcgcgacgctggcggcgatcgtggcgagccagtcgctcatctccgccaccttcttcgtggtcaagcagtcggtggcgctggactacttcccgcgcgtccgggtggtg

SEQ ID NO: 541 - DNA, 693 bp, Zea mays
  misc_feature (168)..(168): n is a, c, g, or t
  misc_feature (500)..(500): n is a, c, g, or t
  unsure (1)..(693): unsure at all n locations
gaatctgaatatctgggctcgcaccattgaaaaccgttttcccaaattttccattcaaaggatggtgacttggtgagagaattcagcccttgtccttttgcacttgcgtcatatcgtggaaccaccaacatgacaaatggttagtattggactgtggacaaatggaancggaacctagcttcaagaagaggtgccacacctgctgagcaaaagactcaaggcatgtgccatacagattccctgtccctcaaacctaactacgcaagtttaattgaaggattcacacatcttttttttcttgaaaacacagtagagctgcatattggtaatattaaggtgaaagaaaagggataacatcccttacacccatccatacacaacaacactatagtccatgtgaaatgtccatgaccttgaccggatcataggcgtgttttggcgtggtacatttgagaggattttttttaaccctaacctgaaatttgctcccatggttagtngaacccaggacctaagaagtgccactagagtcacctgaccagctcagctagaggcccattcacataacataatagctaaacttgacctccttacctagcttaccacaaatttatttcctgccgttgctggcatgctatttattactggccatatgattcacatcccctcatccaaaactgagattcatgtgca

SEQ ID NO: 542 - DNA, 377 bp, Zea mays
gaggaataaattataatgagaggacttaacatctttggtacagcactggttattgttaagtggaagcagtaagctctcaatgcagaaaattgtcaaaattaaaattatgttttatcttgtagttactgttgacattgcatagtacgtttgatcaattgcagggcttcgagctctcctgtggcttcgttaagcaatgggagctgatacgtgaatcacgtgatgagggtttcaaggatggagtaggtattgatgttgctatcagtatggtttctgtagtcccatggaacaatggtccatggatagtctgacaaccttctctacagaactttggaacattcttctctcatgtatgttgtctgtcttcagttaacatgcca

SEQ ID NO: 543 - DNA, 510 bp, Zea mays
  misc_feature (12)..(13): n is a, c, g, or t
  misc_feature (38)..(38): n is a, c, g, or t
  misc_feature (41)..(41): n is a, c, g, or t
  misc_feature (43)..(44): n is a, c, g, or t
  misc_feature (47)..(47): n is a, c, g, or t
  misc_feature (226)..(231): n is a, c, g, or t
  misc_feature (274)..(279): n is a, c, g, or t
  misc_feature (303)..(305): n is a, c, g, or t
  misc_feature (405)..(405): n is a, c, g, or t
  misc_feature (428)..(428): n is a, c, g, or t
  misc_feature (470)..(470): n is a, c, g, or t
  misc_feature (491)..(491): n is a, c, g, or t
  unsure (1)..(510): unsure at all n locations
catgcatgcatnnatatgttggtacggtgttgcattantantnnatngatgatagctcctcgactactgctgctgcttactaagtaccatttggcctgcttcctggcgctgacgtggatggcttgcctggaccactcgaactcggcgtcccactccgtcgtccgcccgtcgtagtggaacaacatgacgtcgaagttgtccgagaactgctcggtccatccatggnnnnnngcgtattatatttgtgtcgtcgtttaccaacaagctagccatnnnnnncaatcaaagtgacttcaatcttannnccttgtgaaccgtcgcgttgacattggctctctcgctgtagcccaccgtcagcgccaccaggtacttgcgaacgggggtgtcctgcgtgcgcatcacacnatcggacaaatgatgtttatttnggtgcatggtagttacaagcagccagcaaaaagatcatgagngagagagcgacctcacgcggntgtccccagagccgacgca

SEQ ID NO: 544 - DNA, 602 bp, Zea mays
  misc_feature (7)..(16): n is a, c, g, or t
  misc_feature (23)..(23): n is a, c, g, or t
  misc_feature (120)..(120): n is a, c, g, or t
  misc_feature (525)..(526): n is a, c, g, or t
  misc_feature (547)..(547): n is a, c, g, or t
  misc_feature (556)..(562): n is a, c, g, or t
  misc_feature (566)..(568): n is a, c, g, or t
  misc_feature (572)..(583): n is a, c, g, or t
  misc_feature (585)..(591): n is a, c, g, or t
  unsure (1)..(602): unsure at all n locations
agcagtnnnnnnnnnngggacancattgtctttggccgatgcccgatggtgtgtccatgggaagagggtaagggttgggcagaagcatttaggtagaggattggccctctgataccattnaattcaggatatagctcttgaataatagattgattagaagtatacagtacatgaatatataggcaaggattccttgggtttggtttatagaagtatgaccaatcatctatcaagaggctcagggcctgtggccatgggcccaaagggcacagtccgctaagcctaacagctgcctaacatactaaattcacagtgaattgttaaaaatatatcactagaccatttactctcttttgtgaacaagttgtcgattcctctttgattggggttttatattgtaattgctttttgatcaggattttatattgtaatttagatttcatctaaactatcgtgcaggctgctgtcctcaaggaaaatatgaacattgatttgcgtgtcatgggaatagctggttctaggacnntgcttttaagtgatatgtaantgaaaaagnnnnnnntttnnnctannnnnnnnnnnntnnnnnnntctacttttat

SEQ ID NO: 545 - DNA, 735 bp, Zea mays
  misc_feature (179)..(179): n is a, c, g, or t
  misc_feature (185)..(185): n is a, c, g, or t
  misc_feature (190)..(190): n is a, c, g, or t
  misc_feature (522)..(522): n is a, c, g, or t
  misc_feature (604)..(604): n is a, c, g, or t
  misc_feature (606)..(607): n is a, c, g, or t
  misc_feature (614)..(614): n is a, c, g, or t
  misc_feature (632)..(637): n is a, c, g, or t
  misc_feature (661)..(661): n is a, c, g, or t
  misc_feature (663)..(669): n is a, c, g, or t
  misc_feature (685)..(686): n is a, c, g, or t
  misc_feature (689)..(689): n is a, c, g, or t
  misc_feature (691)..(694): n is a, c, g, or t
  misc_feature (705)..(712): n is a, c, g, or t
  misc_feature (715)..(715): n is a, c, g, or t
  misc_feature (717)..(721): n is a, c, g, or t
  misc_feature (724)..(733): n is a, c, g, or t
  unsure (1)..(735): unsure at all n locations
agtatcaaaacttgaaagcaaatttgatacacgctgatattcgagtgcaccaccaagaatcaagattggaggcttttccttttttgatgacatacgccggtgagcaacattcttcttacaaacaactccttttacaacgaaactgcaaataaaggaagatgtataaaaccaaaaaaaangaactngtggnaaccaaagaaatgcacagataaatacagtatgaaactcaaaacgtaatagatcaataaaacaaagaaagttcacatcaagtgtcatcaactatgtctttctagtatgaattacaaagcttcagtttcaattaacttaaggttatggatgctcaagcatattgatgtaaaatcataaaggcatatgaaggtaaatagtgatgcatggaaattggaaaatagatttgtttacctttcacttgggtgaccacaagctaagcatttcaccttaacatagccaccagggtccatctgaccgcctttgctggtggtatctggcttcaaaagagatgcngcttcccaagacagagaagtaactatatctagccaactttctttgccactcccatcaactaatggtaccttttcagcctgangnngttgagnaactaacgcccgaaagtnnnnnncaactatgtctttcatggctttcntnnnnnnntcagctgacttatctnnacntnnnnagtgcccactnnnnnnnntgntnnnnngtnnnnnnnnnnac

SEQ ID NO: 546 - DNA, 404 bp, Zea mays
  misc_feature (2)..(4): n is a, c, g, or t
  misc_feature (43)..(44): n is a, c, g, or t
  unsure (1)..(404): unsure at all n locations
tnnncaatcagccccaaagcttcgtctgtcagttcacggcagnnggaaagatccagagcctccaatgaaacataacacttgcgagaaattgcaagcgcagtaaggtctccaacctaaatgaaatgcgtcagatgagaactaattatgaggtggacatcaccaaaattggtcaaggaaacagcacgtgctaacaaacttaataaaatttcccagtcacatcgagaagaaacaaacaaaataaagagaatggcagtttaggttgttatgtacttcaaccaacgatcatggcctgtttggatttatggatttactaaacctagcatcgctaactattagcaccagggcccataaggctcaagtgcaagtggagagcttgaacaaggcaccaaaaattctagggtccc

SEQ ID NO: 547 - DNA, 695 bp, Zea mays
  misc_feature (78)..(78): n is a, c, g, or t
  misc_feature (83)..(83): n is a, c, g, or t
  misc_feature (180)..(180): n is a, c, g, or t
  misc_feature (277)..(277): n is a, c, g, or t
  misc_feature (376)..(376): n is a, c, g, or t
  misc_feature (467)..(467): n is a, c, g, or t
  unsure (1)..(695): unsure at all n locations
ccaagcttctgtttgtggttcgcatccgtgggtatggttctctcacattggttgctgattcctattgctacgctcaantgttnattgttgtcaaatgtgtcatgtagtatcaatgccatgcaccccaagacccgcaagatcttgcagctcctgcgattgaggcagatcttcaacggtgtnttcctcaaggttaacaaggcaaccattaacatgctgcgcagggtggagccatatgttgcgtacgggtaagtctgtataaatttagcagcaatgagtncattttgtatcaatccccacttacgaatgtgatgtttcccaacagatgttcctatcgctcccttaattgttttggctagttttctgctagaattgttangtattatataatgtatgtcgtgaattcttattcttactagagtttaaaaagtaaaaggagtgctatgagttctcattcaatcttttcacanatttatgttgtccatttaaacgtgtttgtagagaacttatggctgtgttagttattcaggttgcttctgggtcaaagaaatggaacagatcataattcaatttgtttagtcactttagcttattttccagatccctgtttttttttaaaaaaattcgcaagtaagaaattccggtcgattatcgttgtgatgtcctgaagtctggaaatgtatgtttcgtcgtcagat

SEQ ID NO: 548 - DNA, 696 bp, Zea mays
  misc_feature (528)..(528): n is a, c, g, or t
  unsure (1)..(696): unsure at all n locations
acaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagacaagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgtacgtatatctgcatcaaactatcagagcacttcattttttnacattatctttattattatttttgttatattatcacgcacatcctggatcaacattcaaagcattttaaattttctttatttactttattgatatatttcttgttgattgaattatcaggcaatccctcctggcatggagtttagtcatatagcaccacatgatgttg

SEQ ID NO: 549 - DNA, 593 bp, Zea mays
  misc_feature (3)..(7): n is a, c, g, or t
  misc_feature (9)..(9): n is a, c, g, or t
  misc_feature (11)..(12): n is a, c, g, or t
  misc_feature (347)..(347): n is a, c, g, or t
  misc_feature (366)..(366): n is a, c, g, or t
  misc_feature (498)..(498): n is a, c, g, or t
  unsure (1)..(593): unsure at all n locations
aannnnngntnngattttcaaccaaactggcaatctgatgctgcctcagcaattgctgctgctgtgatacaatgcagaactgctagtgggaagcggcgaaacatcgggacaaggggcgacatatggctcctgttcgttggtcctgaccaggcaggcaagaggaagatggcgaatgcgttgtctgagcagatggtaaatgctgaaccagtggttataaactttggtggcgactcccgctggggcaaggatggtaatggacggcctaatccaggtttctgggggaaaacctcgctggaccgggtcactgaggcagtccggcagaatccatgttcagtgatcgttctcgngggcatcgatcaggtggangccgttgtgcggggaaaaatcaaccgggcaatggatacgggccgcctgccggactcccggggccgtgaggtcagcctcggcaatgtcatcttcgttctcacaacggattggttgcccgaggaactcaggagnccgaagtttgacacaccgctccaagacgaaggaaagatgctcgagaaagcacactcggattggcagctagagctttctatcggggacaagcagca

SEQ ID NO: 550 - DNA, 685 bp, Zea mays
tcgactctataggatccccctgatggtgcaaacaacacagaacgttagctatatatttaattaaataaacatataatgtacacccgtcaggtcaggtcacgtcacacaagagtaagtggtatcgtcgctactggagttgcatgaagtcatcaacatatttggagtttacccatcatttctaggaaaatagcattagatgattatcattagaaattatttaataatatcgtttcactgtttgtagagtgaagtttaaatatagggaggatgatgtgtaagctgcggagataactatcgatgggaatattatatatagtttacaaaaaagggattagtttgacttaaggataaagtcaacatgaactatagtttacaagaaagggaatattattagttagtgcctagaggagtatgatcaaaacagcattgctttgccattattaggtagggtgagcgcagattgcatttcaggatggagactccatgtcccggtgtagtctacaaaaagtttctttatcagagtgaaggcaggttgttatgtgttgtagctacatatttatgtgggattgattatttggacatataattggtcttcattggaaggtattataattatgtaattatacatgttgttggtcgatgtagctatatatctggaacgatttggtatcttctcattcaaggg

SEQ ID NO: 551 - DNA, 561 bp, Zea mays
  misc_feature (276)..(276): n is a, c, g, or t
  unsure (1)..(561): unsure at all n locations
tccatgtcataaatagaatcccttgagagagctcgcccaacttcatcatccaccatcctgatatagtctggcacagggcgtaagaaaggatctgtaacaatcccttccatctcaccagaaacttcatgtaccccaggaattgggattgcctttccctgagaattacgctcacagcccacaacatgcaactctttgaataacagccagtcccacctatcagtgaactcaagcttccatgcatcatcaactgtccacatgtaggcttgagtatgacgnttaatgacatatgacctcatatctgaaggtttaagcaagtacctagtaacaccttgtatcttcacaactatacaccacttattggtttctgatagttctagcataacttcggcaccttcctccctccagcacctatcagcttgaaaaactaaaaggtttgctttgctgtgaacagaatctatgtcctgtctcacctcagccaaggccagcttttcattcattctctcaacagggctcttcaaagatctctttctcctagttgatcccatgggagttgaaacatca

SEQ ID NO: 552 - DNA, 841 bp, Zea mays
  misc_feature (8)..(14): n is a, c, g, or t
  misc_feature (16)..(16): n is a, c, g, or t
  misc_feature (178)..(188): n is a, c, g, or t
  misc_feature (436)..(437): n is a, c, g, or t
  misc_feature (782)..(793): n is a, c, g, or t
  misc_feature (795)..(839): n is a, c, g, or t
  unsure (1)..(841): unsure at all n locations
aaacagcnnnnnnntnctgaaacttttacaggtgccaatgccagtcctacagatgatttatgccagcttccattagataataaggattttcaggtagttaatatagaatgtggcacaccagttgaagttggtggatttggtttgtcaaaatcaatacacaataatccagtgttggtcnnnnnnnnnnnagctggatcttccgcagagttaattaataaacagcaagaaggtcctgaaacttttacaggcgccaatgccagtcatacatatgatttatgccagattccattagataataaggatgttcaagtaattgatatagaatgtggcacaccagttgaagttgatggatttgatttgtcaaagtcaaagtaagtttctttgactccaattatttcctactctatgctgaagtttttgtagtgaattttttttnnggcatcatataggaattcctgatagtcctgtatgcgtctctggccttttccctgtgtgtcaagagaccagtgagatatggttcatgacagtgtttatttcgttagcacgccaatatattgtttgttttcagtgtcatgatatttctgctaaaagttaaaaattttgattcaaccaggaatgagatgatgtgctctagcatggatagcatgatggaccccggccatggaatacatacggatattcttcctggtattcaagatggatacagccttgcattttctgattttcttggttctgatataccatgctacccatcaatgcaatcagatcttcatgctggaatnnnnnnnnnnnncnnnnnnnnnnnnnnnnnnnnnnnnnnnnnnnnnnnnnnnnnnnnntt

SEQ ID NO: 553 - DNA, 491 bp, Zea mays
  misc_feature (262)..(262): n is a, c, g, or t
  unsure (1)..(491): unsure at all n locations
gagagagcttggtgtaagtgaggaatgggtgtatgtactgaccaaggctgaggcatacaagctccattggtatgccctggatccagtgtttcagaaatggcagaggttgccaccgatgccttctttcgtcaatcaggaggaatccaatcggacagcatcttcggcgttctggatgtggaatgttgtgggatcaagcattaggattgctgattacgtgaggggcttattttggcgcaggaacagtttggaccagatgcccttntgcggttgttcagtgggtgttgctgatggttacttgtatgtcattggcggtttttccaaagctgttgccctgaatcgcgtttgtagatacgacccttttctcaatttgtggcaggaagtgagcccaatgatgactgggcgggctttctgcaaggcggcatttttgaatggcaagttatatgtagttggtggagtcagcaggggtcggaatggcttgcttcccctgcgtt

SEQ ID NO: 554 - DNA, 568 bp, Zea mays
  misc_feature (15)..(15): n is a, c, g, or t
  misc_feature (24)..(24): n is a, c, g, or t
  misc_feature (192)..(192): n is a, c, g, or t
  misc_feature (215)..(215): n is a, c, g, or t
  misc_feature (252)..(252): n is a, c, g, or t
  misc_feature (255)..(255): n is a, c, g, or t
  misc_feature (260)..(260): n is a, c, g, or t
  misc_feature (299)..(299): n is a, c, g, or t
  misc_feature (371)..(371): n is a, c, g, or t
  misc_feature (399)..(399): n is a, c, g, or t
  misc_feature (431)..(431): n is a, c, g, or t
  misc_feature (444)..(444): n is a, c, g, or t
  misc_feature (511)..(511): n is a, c, g, or t
  misc_feature (517)..(517): n is a, c, g, or t
  misc_feature (526)..(527): n is a, c, g, or t
  misc_feature (557)..(557): n is a, c, g, or t
  unsure (1)..(568): unsure at all n locations
ccctgatagtcatanaagggagcnaagagcttgttcttggctgcttgaccgattcttgattgagctgctgcggatcttggcaaagggccaagagcttgctgtgtctggaattcttggtcagccgtgccggatagggtgagggtgccatgacagcatcgcagtcctcgatgagcggcggcggggagccggggntgcggacggtggtctggttcagncgagacctgcgtgtggaggacaacccggcgctgtcgncgnccgcncggacgggcggggaggtcgtgccggcgtacgtgtggtcnccagaggaggacgggccctactaccccggcagggtgtcccggtggtggctcagccaaagcctgaagcacctngacgcctcgctccgccggctcggcgccngccgcctcgtcacccgccgctccagcgacgcngtcgtcgcgctgntcgacctagtccgcagcaccggcgccacccacctctttttcaaccgactctacggttcgatcacccntctctntctctctcnnctctgctctaggtgttgttttacgccttgntacatgttgca

SEQ ID NO: 555 - DNA, 772 bp, Zea mays
gtcggtacccctgccttgacttctacctcctgcttctctttgtcagaatcacccgcaggagtaccagcattttttggtttccgaccaggcttagcttttccttcagtggacttgccttcgtcttttgaatccttgcctttgataatagcctccttaggtttgctcacactcttatcatcttttgtcccagttgaaacattagccttgtccttggagttcttctcaagttcttttttaaggttggggccagttttaggtgtttctttggtaaccttgccggcagttttcccctttgtgctcggagtagctgaggtactgggtgtcccattgctggatcccacaccttttggacgtcctcttttctttggaggatccacagcatcactgcaaccatgcagaaaacagcagtctcagaaaagctacaggcacgagtcaatcgtcacttttttgcatcaattacttaccttttaggtgtttctgtattttcttccttcaatgcatccgcttttctttttctgcctcgtggcctgttgaaacaaacaataacacaaacttcacaaaaccacttatcaagagaaatgagattattcgcatgcttggatttcagataaatagtcaattatcaattgccagcaggggcttatgcaatttgctggtatccacaaactatttaagctaacatttcccgtgcttctttcagaaaaacaaacaatttccagactaaaaaaatggaacttgactaacactatgcgtctaattggcaactcaacag

SEQ ID NO: 556 - DNA, 743 bp, Zea mays
  misc_feature (629)..(630): n is a, c, g, or t
  misc_feature (640)..(640): n is a, c, g, or t
  misc_feature (642)..(642): n is a, c, g, or t
  misc_feature (651)..(651): n is a, c, g, or t
  misc_feature (677)..(677): n is a, c, g, or t
  misc_feature (691)..(693): n is a, c, g, or t
  misc_feature (695)..(695): n is a, c, g, or t
  misc_feature (698)..(698): n is a, c, g, or t
  misc_feature (715)..(718): n is a, c, g, or t
  misc_feature (722)..(723): n is a, c, g, or t
  misc_feature (725)..(729): n is a, c, g, or t
  misc_feature (732)..(733): n is a, c, g, or t
  misc_feature (735)..(736): n is a, c, g, or t
  unsure (1)..(743): unsure at all n locations
tgagctgaactccattcacaccttcgtgccacattggattcagcaacaatttcttcgacaaaaaacaaatgccataagacagttatttactgttcattagttgtcggtagttcgtcattaagatcaccatgttcacatatacaaacaaggaaaacaaatcccacatatgcaatagcttttcacctcacaaatatgtcagtcagcaaaagacagaatgtagatcttccttacaaaatagctttttaacatcccaaactgccagtgacaccagaattagtgatcattaggcatgtcaaagcatgccaagaattagtctcggtaacacaataaatccattaaatagcatatacattcacatgaaaacacctatgccatgaaggctcgcagcgagcctatatgccagtatatacaaccaaaccaatcttcaatgcaaatcattcctaaagaaaacttagcactgctattcagttatatcaaagcagagttttgcttcatcccaggggccattgatctcaaacttgtattcctgaatccttataagccagtaagggcaaacgattgagacaaaaacaagtagcgccaatagaacagtgaagaacattcgatgcaactggtatgtgacactcagnnccacagccantngcgtgaagnagaatagcagatgaagcctaaaatgntatttcttcacacnnnangtnatgaggggtgcaaagannnngacnngnnnnnagnncnncatgatt

SEQ ID NO: 557 - DNA, 551 bp, Zea mays
tgttttgcaggtaggacagaagagaggggatagaagaagaggctcctttttgccgtgtgagcaacagatttgatgtagcattgttaggcgaataaacagctattgtacactgtagaggcaaaagaaacaaataaacgtggtttccattttctttaaattttttggggataccttgggagcggcagaaatcatacattttgatagacataattcaatagggatttctagatacgatacttgtcaaaaaaaaaagaattcatggagaaacaacggctgtgataatggtttttttgtaggaaccttttctttatacaattatactattgattaattgttatactattactacattgttacctgattctccaactgtgtccagtgtttgacttctgcgcaatcacagtctctttggccaagttgtagatgttgcgcgtgccgctgattactgtactggcttgttcgacgagaaggcgtagttgtagtcgtggccgccgatctccccaacatgaccaggaagaatgagccagcctctcgcataattccccgctgca

SEQ ID NO: 558 - DNA, 499 bp, Zea mays
  misc_feature (488)..(488): n is a, c, g, or t
  unsure (1)..(499): unsure at all n locations
acagtttcattactaccaagtgaataaccaagccatccaaaagccacagtgcatggatacaaaactacaagaccagaacataagcagtaatgtgtacgctgttcatgagactgacatctaagtttcgaatagcaattgcggccaaaacaatctgtttgaagtttcctttgatcaacagaaagggaaaggaaactcaaggcaagggcattcacaaaatccatgcaaaggcagcaccggaaaagtggagctgcttgatcccaaaactggatgcacatcgcagagcacatcatgcaggcatcagcacaagccaaacagagacctcatctccatccaatcttatatcctcggttgctgtctcaacaatgggacaaaaaaaaggaagaatctgacggacctccgaccactagagcagcaacataccatggtgtgttattttgcgtcccctgcacatggatagcatgaaaaagcaccccgcctctaaaaatganttcatctctca

SEQ ID NO: 559 - DNA, 738 bp, Zea mays
  misc_feature (227)..(227): n is a, c, g, or t
  misc_feature (349)..(349): n is a, c, g, or t
  misc_feature (477)..(478): n is a, c, g, or t
  misc_feature (485)..(489): n is a, c, g, or t
  misc_feature (529)..(529): n is a, c, g, or t
  unsure (1)..(738): unsure at all n locations
ctatccccaaagagtttaaaaaagggttcaattccttggccatcttggtcacttgcgagttgtggaagcacagaaaacgcttgcgtgttcaatggtgctcatccttggactcaaacgatttaggctcaagtgaccgctgattcccatatgtggtgcctggctggggcttctaaccccatgaagctcctcctatgggaggctcctacccattaggctggtgtggcctngagtggtcttagggtggttgtgttcagttgttgtgtagtgtgtttcaagtgtgttgggggtgttataacccccattgtaacaaattattttcttccttaatgaaatgacacacagttctccngcgttgttctaaaaaatagattttagatatgtgctacacgaatatgttgtgtatgtatgacactggcgatagacacaataacatccgaaattatgatatcagatctcaatcttatttatgttgtctcnncaagatnnnnnacaaggaaaagaacctagacagatagacaagttcatcganacaataaatagatattaatcgatggtgcattagtttttgtatcacacacctttagtctggaaatctttatccgttttaacgaatgcagcaaccagcgctcttgggagtgcagcaagccagtcttccctgttgagatcagcagggaccgcgttcaagatgttgttcaagagattctctttggtgtaaattgcggccccgttcccattgtg

SEQ ID NO: 560 - DNA, 465 bp, Zea mays
  misc_feature (232)..(233): n is a, c, g, or t
  misc_feature (259)..(259): n is a, c, g, or t
  unsure (1)..(465): unsure at all n locations
ccactgccttagaaagtaccaatgttttatcattgacaaacgaagaacaagatctcgccacatttcctccctcttcttgtggtggtgaggagacagaagcttgcatcccaactttttcactgaactcagtgggtgcattattgaaatgtgaagacatactatctactaagcattctgttgcatcaacagataacacatcctctgcacctccatttgtctctattgatgattnnaagttcctataattggctctggctcnaaaatatcactgtccttatctgtaatgttttcttcaagttctctagtagaagcaattgcttcaatttcagtagttagagattgcatgtccaaaaatttgagctcttgttcaccttcagaataagcatgcacatgacactctgatttctccatctcgaatccagaacatgtcaaggaagttccatcaaaccttttttaaggtaacca

SEQ ID NO: 561 - DNA, 1025 bp, Zea mays
  misc_feature (479)..(479): n is a, c, g, or t
  misc_feature (506)..(506): n is a, c, g, or t
  misc_feature (508)..(508): n is a, c, g, or t
  unsure (1)..(1025): unsure at all n locations
agtcgttcttagaaatctcctgctcttgctcgccagcttcatcagcagcaggcgcaggactctcgggcggtgctggctcttgttcgacggccgcagcggaaggtgcacgtgccggctcttgctcgccgcctgcgcccacggatgcggggagcacggccgtttccctgacgaattcgggcttggacagcgtgctcggtttggatcttgtgtattcgtcaacgaacagcatgaactcgtcaggcatcatggcgccgctccacttcgctagcaactgccccgtgatggggtcaatgacgagcagcgccggcagctgatcctcctcgagcctgtagaacgcagccactttctcgcactcgtccgggagcgagtagctgcccctgctcatgccccccttttcaagggagaacacaaagctgtcctggatcacccccctgaccgtctcgtccgcccaaaggtcccggttctgcatctgcgacggnagttcaccggcgccgctgcatgtctgnangttgaccagcaggaaccggtcctccctcgccgcgtgcaccttggcgccgtggaagtacccaacgtacctcagctcgtacggaggcgggtagtaggtatcaacttcttcgtcctcgccgtagcccgtgttgtcgtagtcttcgtcattgtatgcaccatgttcctcccagtcggtggtgcttccgtcgccgtaccccgtattgtcgtaatgttcgtcgtcgttgtattcaccatgttcgtgttcctgccagttgctgctgccgtcgccgtagcccgtattgttgtcgtagtattcgccattgtattcaccatcttcctgccactgccagtcggcggtgctgccgtcgtctctggcaccgtcgggctctgttccccacccggtggctcctatttcgccttctctggcagactctgcttctccccatccggtggctactatgtcgcctggctctgctccccacccggtggcttctgtttcgccttctcttacaccatcgggatctgctcctccccacccg

SEQ ID NO: 562 - DNA, 1055 bp, Zea mays
  misc_feature (58)..(75): n is a, c, g, or t
  misc_feature (902)..(902): n is a, c, g, or t
  misc_feature (1023)..(1054): n is a, c, g, or t
  unsure (1)..(1055): unsure at all n locations
tgacgcgcggaactggcggtggcgagcgcagctaatggccatccatgccccgctccgnnnnnnnnnnnnnnnnnntgcgaggaaggtagccagacgcgtataaagggcagccagaaattcggatccacctgtatgcgtctccgttcgttcacgccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatactcgccagcggggtctcccagaggacttcggtggatggaagcaatcatcttagagctagatgctttaagggtgcaccagagcacagcgacaattcatgcgcttggagccttcagccgtcgagtacttcatgctaatgcagaattcattcgatttggcttcttttgattgtttcagaagaagtgttattagtgagtttcaacaaaaaatagctccatattgctctatatcccgtattggaaattctaaggccgtttgtgattactgcttacaacaagaagttttgtttctagttcccactacgcttttttttttgaagnttttgagtggaacatctttgtgttcaacgttttgggaggtgtaggccagtaatactgcaagaaaggaataatttcccttgcagcaatattgttttttgtgatccttgaacaaaattgttcnnnnnnnnnnnnnnnnnnnnnnnnnnnnnnnnc

SEQ ID NO: 563 - DNA, 517 bp, Zea mays
  misc_feature (3)..(3): n is a, c, g, or t
  misc_feature (79)..(80): n is a, c, g, or t
  misc_feature (85)..(85): n is a, c, g, or t
  misc_feature (110)..(110): n is a, c, g, or t
  misc_feature (148)..(148): n is a, c, g, or t
  misc_feature (196)..(196): n is a, c, g, or t
  misc_feature (293)..(293): n is a, c, g, or t
  misc_feature (311)..(311): n is a, c, g, or t
  misc_feature (346)..(346): n is a, c, g, or t
  misc_feature (426)..(426): n is a, c, g, or t
  unsure (1)..(517): unsure at all n locations
tanttttatattccttatgtactgttttcaaggatattgcctcatctttcaatttatttcatagaccccattttttttnnacagntttgctattatttgcgacagttttngttacctaagttatggtctcctgagatctcaagtttcnaacaacggttaaatttgccaatttggtatcctgttaacagatctttcntggggggcatgtcttttttgttttttcttgttcttatgctggctgacattaccaatttgctatcctttaaagccattactatctggggcattctggntctttgtgtttagtgcantgattctggtgaaaatgtccttaactgagttctgntgattattagacttcccctggttcatggtgtctcacaggtatctctgatgtcggagttgccaaattgggagatggactgncatctctacagtcccttgatgtttctcgctgcataaagctgagtgacaaaggtttgaaggcggttgcactagggtgcaaaaaattgagtca

SEQ ID NO: 564 - DNA, 424 bp, Zea mays
  misc_feature (216)..(393): n is a, c, g, or t
  unsure (1)..(424): unsure at all n locations
tgccccagatggtgaagaggtcgcgcgtctggaatgccggcgcgatgcgctcgatgtacgcgcggccccggatgacgacgaggcggaagttggcggtggcgcgcgcgcggtcgaccatggcgcgggtgatgcccccagcggcgcgccatgggtggaggtcctcgtggatgaagcggaagtaggcagggcaggtggaggaggcgttggagttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggatggaggaggtggtgtgcgtcgcggt

SEQ ID NO: 565 - DNA, 1048 bp, Zea mays
  misc_feature (18)..(18): n is a, c, g, or t
  misc_feature (47)..(47): n is a, c, g, or t
  misc_feature (201)..(201): n is a, c, g, or t
  misc_feature (219)..(464): n is a, c, g, or t
  misc_feature (1022)..(1024): n is a, c, g, or t
  misc_feature (1030)..(1031): n is a, c, g, or t
  misc_feature (1040)..(1043): n is a, c, g, or t
  unsure (1)..(1048): unsure at all n locations
tacataaaaaatactacntccgttctcgaatatttatcgcccgctantttattttttactaaaacatgacaaataaaaaacagaggaagtattagacattagtagggttcctcgacaatgctgactacctaaatgtgccgccatatctggccttccagacttgcaacagaattgaaggtaatgcctggttcccctgtcagntgcgtctcacttaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccagacctcagctgtcctaaatcaaaccatactaaattttaccaaagttgtatagaaaagtagtgacatttaccgcattcaggaggcagagtatctctaattgggaattgttcaaacatgtggatacacttcaattcattattttttctcgcaaaacagaaagtaaacttttacttcattaattcaatcaaaaccttttgttcctctattctatagcacaaatgggttgtagtttccatgccacatagctatcaacaaatattaacagtatatctatcaacaaagtgttctaggtctccactaaaatacaaataagagtgtacaacatcacaacatgtcaacatgtcaacatgtcgaaataagggactctctaaataaaaaatatgaactcctggcatccttcgttcatgcaaagaggaacttacgagtatcattactacagctctggccccgaagcaaagaagttgacaagcccccggcacgcttggacagatacctcacatgcctgaaacatctctccatccaagttccaaacactttcgtcatgtgatgannnaaaggnnaacgcttgnnnntgcag

SEQ ID NO: 566 - DNA, 766 bp, Zea mays
  misc_feature (60)..(65): n is a, c, g, or t
  misc_feature (74)..(74): n is a, c, g, or t
  misc_feature (255)..(256): n is a, c, g, or t
  misc_feature (261)..(262): n is a, c, g, or t
  misc_feature (269)..(269): n is a, c, g, or t
  misc_feature (278)..(278): n is a, c, g, or t
  misc_feature (288)..(290): n is a, c, g, or t
  misc_feature (303)..(303): n is a, c, g, or t
  misc_feature (308)..(308): n is a, c, g, or t
  misc_feature (349)..(349): n is a, c, g, or t
  misc_feature (353)..(353): n is a, c, g, or t
  misc_feature (378)..(378): n is a, c, g, or t
  misc_feature (425)..(425): n is a, c, g, or t
  misc_feature (446)..(446): n is a, c, g, or t
  misc_feature (449)..(449): n is a, c, g, or t
  unsure (1)..(766): unsure at all n locations
ggtacccctgcagtacagcttcaggacgtccgtgagcagcctcagcgaggtggaggaggnnnnnnaggaggcgngcccgccaccggtggcggtggaggacagggtcttcgtggccgtccccgaggacaccaagaacggcaagagcaccctgctgtgggcgctggagaacccagccaaggactgcgccggggttgtcgtcgcccacgtccactgccccgcgcagatgatccccatgagtaaggttccattccgtcnncgatnncgtcatntggatgctnctgctgccgnnntctttgcatcctnggagnttcttgtgcaaaaggaaacgctttgggcgttgacatgactntgtnctctgtttcattttttgttgttgtnctattgccggcatggggaaaaactgtggcaaatactgaaagcgctcnttacaccttaataggtttccntcntatagaacctagttcatgatgcactgccttgagggttcagagttgacaggacttactctgttctttccagtgggggcaaaagttcatcacagcacggtgaatccacaacgggtcaacgaatacaggaagaaggtgcgagcggaggtggaggagaaactagatgaatacgtccttgtgtgcagaagacaaaaggtaacaacctccccccatgccgtcatcagacagactagtggcctaataaacaacaaccaatgatacagtaagcacgtacgctaccttaattgactgttggctcatcgtttccctttcacaggtca

SEQ ID NO: 567 - DNA, 951 bp, Zea mays
  misc_feature (11)..(11): n is a, c, g, or t
  misc_feature (42)..(42): n is a, c, g, or t
  misc_feature (195)..(195): n is a, c, g, or t
  misc_feature (239)..(239): n is a, c, g, or t
  misc_feature (244)..(245): n is a, c, g, or t
  misc_feature (247)..(248): n is a, c, g, or t
  misc_feature (251)..(251): n is a, c, g, or t
  misc_feature (254)..(254): n is a, c, g, or t
  misc_feature (258)..(258): n is a, c, g, or t
  misc_feature (261)..(261): n is a, c, g, or t
  misc_feature (278)..(278): n is a, c, g, or t
  misc_feature (294)..(294): n is a, c, g, or t
  misc_feature (299)..(299): n is a, c, g, or t
  misc_feature (312)..(312): n is a, c, g, or t
  misc_feature (315)..(315): n is a, c, g, or t
  misc_feature (334)..(334): n is a, c, g, or t
  misc_feature (341)..(341): n is a, c, g, or t
  misc_feature (353)..(353): n is a, c, g, or t
  misc_feature (417)..(417): n is a, c, g, or t
  misc_feature (434)..(434): n is a, c, g, or t
  misc_feature (454)..(454): n is a, c, g, or t
  misc_feature (470)..(470): n is a, c, g, or t
  misc_feature (488)..(488): n is a, c, g, or t
  misc_feature (503)..(503): n is a, c, g, or t
  misc_feature (511)..(511): n is a, c, g, or t
  misc_feature (525)..(525): n is a, c, g, or t
  misc_feature (584)..(584): n is a, c, g, or t
  misc_feature (588)..(588): n is a, c, g, or t
  misc_feature (590)..(590): n is a, c, g, or t
  misc_feature (596)..(596): n is a, c, g, or t
  misc_feature (675)..(675): n is a, c, g, or t
  misc_feature (686)..(686): n is a, c, g, or t
  misc_feature (688)..(690): n is a, c, g, or t
  misc_feature (716)..(716): n is a, c, g, or t
  misc_feature (742)..(742): n is a, c, g, or t
  misc_feature (745)..(745): n is a, c, g, or t
  misc_feature (750)..(750): n is a, c, g, or t
  misc_feature (810)..(810): n is a, c, g, or t
  misc_feature (819)..(819): n is a, c, g, or t
  misc_feature (835)..(835): n is a, c, g, or t
  misc_feature (849)..(849): n is a, c, g, or t
  misc_feature (939)..(946): n is a, c, g, or t
  misc_feature (948)..(950): n is a, c, g, or t
  unsure (1)..(951): unsure at all n locations
gaatgtgaacncataaaacaaagcttactctttgaagtgctnaaagcaggtccatttcagctttccggattttgttagattcatcatcatcagcttcatcctttaacaacttagcttcaatgcatgaatcttgaagcttctcatacttttcttcatgtacactgggttcgtcttcctgtatgataccatccatcngattattttggtgtttccatattgagtaatagcattaccatctncttanntnnaanatnctancancatacctgattatatgntgatgctagcaacaantaggngctatcaggttcntgngttgtaaaatgcaccactngtgttgnttcatgtgtatngccaataactgaaggtagagcagcagtttcagagaagctgacagcatcgtcagttcctgatganccgtaaactatcattcnccaatctgtgttatcatcgnagtggaaaatcagtgngactaccttcaaaatggntgcatggctgaaagnagcttcantttgctcacatagnaaacctctcctttttgtagacatgtatcgcatgtgagagtgggtgcttttccatgatcnaaananggttgntttgatttttggcatctatctaaaaatggttggtttgggtgcaaaccctaggtttcatttatcatattactttgagcanaggtaaataantnnnacaattgattacaaacatacataagntgtaatgtcttgaatttatttgtaancancactngtcactgatgcctaaaattcatgttagatgacttcacaactaaatttcaatctcttaggnattctatgnaaattttatatgtgantacataatattttnactaaattatttgaggcaaagaactacataactttttttttgcaagaattacatctcgtctgtatatttaggatagtcacctccaaaaannnnnnnncnnnc

SEQ ID NO: 568 - DNA, 1015 bp, Zea mays
  misc_feature (114)..(116): n is a, c, g, or t
  misc_feature (122)..(122): n is a, c, g, or t
  misc_feature (187)..(187): n is a, c, g, or t
  misc_feature (191)..(191): n is a, c, g, or t
  misc_feature (499)..(500): n is a, c, g, or t
  misc_feature (960)..(963): n is a, c, g, or t
  misc_feature (966)..(970): n is a, c, g, or t
  unsure (1)..(1015): unsure at all n locations
tttttcagatatttgtcagcctgtacacattgctgactgttcattatcctgagtgtgttctgactgtagagctgtagtgcaattaatatagactgatctttcatgtgacttctnnncgttcntcactccatcaggctcacatggtatatagtgaacatgcatgatgcactagctaatcctaaaaaangttnactgcttttcatgccttattcgttactactcgtatgctaaagcaatgagcggcagaactgcactatttttatccattattcgcagaaagatactaactgtagcttgcttcctccccacattttcttgacaggtatctgatagctctgcacaccacagactaccaacaacctatgctcttcctcaatacccttgccgtcagtgtgcttgtggtcgcgaaactaccgaatatgcacaaggtccggattttcggaataaatgccgagaactgagcaacgtcatccttcgccagacatttaccctatatgcnnttttcagaacggttttgtgtgttcccccccccttctagtgcctttagttgggctcatcagagcaccagtgttgaaaaagttgttagcaggatgggccttggtcgctgtatagagagatgctcggaggcgtgctgtacatctgatgtgcacggattctgtacactcttaatgttgctatatatacggtttgttgcaagcatctgtcggttgctatatgtacagtgtggttcttgcagagcgatgtgtttcctcggctaccgtaatgccaagatagcagcagtacagcactggctggtgcctgtggacaggcgatgatggattgaggggcaagattattacaaacagttttgcacggaccgtccgatacacatttcttggcgggaaaaactgtttgcttgcctgacatttggcatgaaccgaccgtacgaagatgaactatcagatgaagtcaacggaggtnnnnccnnnnncctccatggtaaaagtcatcactaaaccagttaccatcagatggc

SEQ ID NO: 569 - DNA, 695 bp, Zea mays
  misc_feature (566)..(567): n is a, c, g, or t
  misc_feature (617)..(622): n is a, c, g, or t
  misc_feature (643)..(647): n is a, c, g, or t
  misc_feature (670)..(672): n is a, c, g, or t
  misc_feature (674)..(679): n is a, c, g, or t
  misc_feature (681)..(685): n is a, c, g, or t
  unsure (1)..(695): unsure at all n locations
gtaaaactttggttcgtgagtacagtattcaaaactcaaaaaaaaatactacggtttaattttgaggatactgtggtgttaaaaactgtagtttacaaaatccaaacagacacctcatagcttacaatagctcgattttctccaacaccgtcgtatcagagttatttaaagacacctcatagcttacaataatagctcggttttctccaacaccgtcgtatcagagttattaaaagacgaccccttttcaaacgctctccgcactccacgcgatctcggcctcagctgttgttgacgcgtagatgcagacacgtgttttcattcactccatcggaatccaaatgtgagttcaatgccccggacccaaaaactccatccaatcgagctctgagcgcacagcgcagtccgaggttcccatcactcccacactgtccatccctcttctcctccaccaccgccgcctcgcctcaccccctcccacgcctgcagcccttcctgacgacgggggaggcagggcccgacgccgctgccagctcccgcagcttcgccacttcgcttttctccgnntccacagatcgccgacgccctcttggccctctccaccgcgtagcaatggnnnnnntggatgcaccaccgagcgagnnnnntacgcccgtgctgaagcggagtnnntnnnnnntnnnnnacgcgcgcgc

SEQ ID NO: 570 - DNA, 823 bp, Zea mays
catcatttgagaaccagctccggccaattgatagatatgcaatgcgctttatggaactctgggatccagtaattgacaaagctgctttaaatcatcaagtaaatgttgaggaggaagaatgggagcttgatcgtattgaaaaattcaaagaggatttagaagcagaaattgatgaggaccaagaaccactttcttatgaatgtaagtactttgtgtctgctataatttctttcttggcactttggagcagtctgttcattatcactttggcattctgcattttagctggagctttgtgttcacctcaatttaggtatccttcctttttatgctttagtaatattgagttattgacatcatctttatttcttgcagcatgggatgttgattttgctacgacagcctatcggcaacatgttgaggctttaactcaaaagcaggtcgttattgacttgctaacttgtattcttacgtgtttcacttgaaacacagtgcctttcttctctcttctgacttgttataatacgtgcagttgttagaagaacaggaaaggcaagctcaggaagcaacaaaagagttggaggagaagaatgataatatgaggtactaattggaaaattattttcctgaaacacgaacaatggttgcaaattttgttttgtgattgtctcagttgctctttcttatatgtcaattggcaatattagcatgttatgtgcccacattatttctaatggatgtttttctgtctgttgatttttttttgcttagtctatagcttccctttgatatactattgagtattgactgtacattttggcat

SEQ ID NO: 571 - DNA, 586 bp, Zea mays
  misc_feature (7)..(8): n is a, c, g, or t
  misc_feature (16)..(18): n is a, c, g, or t
  misc_feature (47)..(48): n is a, c, g, or t
  misc_feature (279)..(279): n is a, c, g, or t
  misc_feature (294)..(294): n is a, c, g, or t
  misc_feature (330)..(330): n is a, c, g, or t
  misc_feature (560)..(565): n is a, c, g, or t
  misc_feature (570)..(582): n is a, c, g, or t
  unsure (1)..(586): unsure at all n locations
tgcctgnngactatgnnnatgtaactagtgcaaggcaattgaaggannaatctggagggacgccattctggaaccctttcgatcgagcatacaaattggagttaaggagatactttgttcttaagttgctgaacggtgctatgagtggccttgttcacatgcacaatcatgatagactgcatcaaagccttggaccttcttctgtaattctcaagtatgctgaatattttctttagtttcctttctgcattgtattccctatgttcaactagctacttngatattttctttagntttttttagatacatagcttttgctatgtacttagntatacaatatgtcttatgatttagaatggatggagtactgaagattgtgaaattctcatctgtagtacggcattggataaagagggacgctacttggttccaaggctgagagatttggcattttctgtagatattgggtatatttccatccccttcctaactttattatatatcgggatagaatcatctttaaaaaaaaaactgttggcaattataggtactcatctatnnnnnntggannnnnnnnnnnnngact

SEQ ID NO: 572 - DNA, 1005 bp, Zea mays
  misc_feature (398)..(398): n is a, c, g, or t
  misc_feature (403)..(403): n is a, c, g, or t
  misc_feature (405)..(405): n is a, c, g, or t
  misc_feature (419)..(419): n is a, c, g, or t
  misc_feature (433)..(433): n is a, c, g, or t
  misc_feature (445)..(445): n is a, c, g, or t
  misc_feature (481)..(481): n is a, c, g, or t
  misc_feature (486)..(486): n is a, c, g, or t
  misc_feature (543)..(543): n is a, c, g, or t
  misc_feature (554)..(554): n is a, c, g, or t
  misc_feature (566)..(566): n is a, c, g, or t
  misc_feature (909)..(909): n is a, c, g, or t
  misc_feature (911)..(917): n is a, c, g, or t
  misc_feature (919)..(919): n is a, c, g, or t
  misc_feature (921)..(922): n is a, c, g, or t
  misc_feature (924)..(926): n is a, c, g, or t
  misc_feature (928)..(928): n is a, c, g, or t
  misc_feature (930)..(930): n is a, c, g, or t
  misc_feature (932)..(937): n is a, c, g, or t
  misc_feature (952)..(959): n is a, c, g, or t
  misc_feature (961)..(961): n is a, c, g, or t
  misc_feature (969)..(969): n is a, c, g, or t
  misc_feature (971)..(1002): n is a, c, g, or t
  unsure (1)..(1005): unsure at all n locations
aggagactcttcattttcctcctcttctatagcacctacagcagttggttcagccttcttttttttctttgggaaagggtcaaaattcttgtgccggagctccaaaaatagatctgcccttttcctgttgttaactataatttcattatcaacaacacagcggataaacctaactttgttttcaagcttctttaagtccagcttgatattcttcaacaatgcttcctgcacaaataaattggttaatatggctttcagttaatattctaaaaatgacaaagttcatcacatgtacctttctcttacaatagaattcaagccttaattgaaagaattcctcaagtactgcaaaaatatcacactcagttattaaataacaagaaaacaggggtctgtancaacncntaatacgatacatnacttactttgctcnggagtgtcatanttccgaattttaccatctgaatcaaacaagtgcatntttgntgtcccaattgttgttgtcagcttaaacttcttcactagtccttcttccatagctanattcatatttntctcacttaatntgaactgaatgtaaacatcttcattatcaccttgacatgtgacatcctgtaaaatagttgcaattgaggaatagcatctatgacggtggaaaatttatgaacacaattgtaagcgtttttgttttcaacgacctctatgaatggtactttgtccttgttcttagtatctggagccaaagtctcaagataatctttgtaatcctgagtccaacggcggattggcaattcagtgatcctcagtgtagtgttgtcaagaacctcgatgattccagtgacagtatatgtggaaccagctacctttgtattgactgtcttctctatagagccctgtaaatttgggcanannnnnnntncnntnnnanancnnnnnntttatatagtactcnnnnnnnncntttttatntnnnnnnnnnnnnnnnnnnnnnnnnnnnnnnnncag

SEQ ID NO: 573 - DNA, 987 bp, Zea mays
  misc_feature (1)..(4): n is a, c, g, or t
  misc_feature (40)..(40): n is a, c, g, or t
  misc_feature (75)..(75): n is a, c, g, or t
  misc_feature (220)..(220): n is a, c, g, or t
  misc_feature (257)..(257): n is a, c, g, or t
  misc_feature (466)..(466): n is a, c, g, or t
  misc_feature (469)..(469): n is a, c, g, or t
  misc_feature (591)..(598): n is a, c, g, or t
  misc_feature (600)..(602): n is a, c, g, or t
  misc_feature (800)..(800): n is a, c, g, or t
  misc_feature (904)..(904): n is a, c, g, or t
  misc_feature (918)..(918): n is a, c, g, or t
  unsure (1)..(987): unsure at all n locations
nnnnttgacgacggcgaggtggagatcccgtccgcttaanaaggtattgtgagcaagtttctgttattttactgnaataatattgatgacccattttgcattgaagttagccaatacagtttatgctatgctttgttcacgttcacgtcacgttcccttcagcttatgtcagtatgaactctgggaattgccttcatttaagcgatgctccaccgatccntttgttcatgaattgatagaatgtgattaaacattgntatcaagtgggtttcagggttttaattgctgttaaatattcaaaatctaaagatttagagttcaatgtactgaatgaattatgctttttctctcgctgatcgatgtctcagttatggatgccgtgttcagttagtagcttgacacagtcccttttgtaaccttgcaggattggtgtccaggactgtgttatctttgctgctgaagccanttnctctgcctagattttctcatatttatttgaggtgggggtggacgtggacgtggaactatggaagttatcacagcggagttttgcttagaaactttgtcatgctttaagtctgagacaatttnnnnnnnntnnnatgaacattcctaggtacaatcgaagttaccagtgcctgagttttgttggaatttttcatgcgatgtttaaaatttgactatattgcatggccaattggttatttgtctggttagtgattacatcgttgaggcgcatagtacttgaaatatgtttctgctacccgttgctatggttttctggtggatgcgtgctcttntatatatataaaacaaagtgttttttcattagctgcattgcacaaggccctggctggatgtggcagtagtaagatttcccaccatatgcagctaaacaatgtgntgtataacttgagnctcctttaacacaacaacaacatttgaaaagatgcattacaaatattgcttttttcaagaaggccatcc

SEQ ID NO: 574 - DNA, 574 bp, Zea mays
attcgagctcggtacccctgagcaagcccttgcccttgcccttggccggcccttgctgtgccccccggcccttctctctcctctccctcagtccctgtcttgtcctatcctagtaaaagaaaggacagtttgattgcacaggtagcccaccgctcaaatcatccgcttcccctcgcccttcctctctcacacccaaacaaacaagcctgctggatcgaccgagttcagccgagctagctacctaccttcagaaaccctcgcaagctagcagcttctctcaaccctcgacttccttctacctatacaaccctaaatcagtttgcttccttcggttcttgcgaattgccaggaacgaaagagctttgccgctctcgtgttacagaagactcggaaagagagatcgagaggaaggagtaccagatagacgtaccagcaggcagcagctagctagaggggcgagcgagccatgtgcgactacttcctacaaaggatggaggacgaccgccaccaccaccatcaggccggaggagacctcacggacgtcgtccgagccggcggcgcgatgcatcaggca

SEQ ID NO: 575 - DNA, 498 bp, Zea mays
  misc_feature (78)..(78): n is a, c, g, or t
  unsure (1)..(498): unsure at all n locations
ggcggatatgtacaaggtgtacgtgagtttactacactacctatattgcaatattatatagactggtagtcagagttntaaattggtaatcatttgatgactaaaataaccattttttatatgctatggaaacaaacatctagctgattgttgagaacactgagatcctaccaggtttgaggtcacgatgaaagtagcccctctggtgcatgtatgcaagagcctgaaatatctgaaaacaccagttgcggacttcagactcggagaaaggcttgaccctttctttcataagttgatagagattacactcctataaaaacaagggttcagattcaagaacacaataatggtgcagtagaatatttgctatacataacatatttaccatgtattccattatgaagtataatatatcattttccctgataacctctttgagcttcacaatgttaggatgattcatgcgccgcaaagacttcaataaaataacaataaaag

SEQ ID NO: 576 - DNA, 1127 bp, Zea mays
  misc_feature (17)..(17): n is a, c, g, or t
  misc_feature (36)..(36): n is a, c, g, or t
  misc_feature (110)..(110): n is a, c, g, or t
  misc_feature (120)..(120): n is a, c, g, or t
  misc_feature (254)..(254): n is a, c, g, or t
  misc_feature (319)..(319): n is a, c, g, or t
  misc_feature (460)..(460): n is a, c, g, or t
  misc_feature (478)..(478): n is a, c, g, or t
  misc_feature (483)..(483): n is a, c, g, or t
  misc_feature (506)..(506): n is a, c, g, or t
  misc_feature (512)..(514): n is a, c, g, or t
  misc_feature (547)..(550): n is a, c, g, or t
  misc_feature (560)..(566): n is a, c, g, or t
  misc_feature (570)..(573): n is a, c, g, or t
  misc_feature (575)..(575): n is a, c, g, or t
  misc_feature (577)..(579): n is a, c, g, or t
  misc_feature (581)..(581): n is a, c, g, or t
  misc_feature (584)..(588): n is a, c, g, or t
  misc_feature (590)..(591): n is a, c, g, or t
  misc_feature (597)..(597): n is a, c, g, or t
  misc_feature (600)..(601): n is a, c, g, or t
  misc_feature (604)..(605): n is a, c, g, or t
  misc_feature (616)..(617): n is a, c, g, or t
  misc_feature (619)..(620): n is a, c, g, or t
  misc_feature (623)..(640): n is a, c, g, or t
  misc_feature (649)..(649): n is a, c, g, or t
  misc_feature (658)..(658): n is a, c, g, or t
  unsure (1)..(1127): unsure at all n locations
tgtggttgcatcagaanaatcaactgtgcattcaanaaataagatcaatgactacttaggaacaatacctaatagtaaatttcgaattacgtaacaaacaaggaactttnaagctttcangataacagatagagcgcaaaaataaatttcaccttcctcaccctcctccacttcctccactttgttgtccccttccaaaaactggacaacttcctcctgctctgggccatcacatttcacatccaagaccacgnctagatgataacacacaaccagcatcaaacactgtccccataaaaattgaacagtagaaccaaancaatctaggaagtgaaatcctctgaccttttggttcctcttgctgcaccttctcctccccctttgggtcatcacatttcacatccgagacagcagctacatgataacgaaatcagcatcaaaaggctgtccacaaacaacnggatagtagaagcaagtngatcngggaaatgaaatcctctcacctntcggtnnntcttgctgccccttctcctcttttgatgcgacnnnnaccacctcgnnnnnnngatnnnnancnnncntcnnnnncnntgtctngtnntcnnatacatcttcnncnnggnnnnnnnnnnnnnnnnnncccgcggcnttgcgagangccgccctcctccgggtggctggggtcggcgccacctcgcccgtcctacgaacggcagtcctcctcgctgttgcgcgcgcactggacgccggaaccggagtaggaagaggcgcgggtgtggcccgaataccgcggcgagtgctgcgcagcaccacgccgggagtcttcacgttctccttcatctcgtcctctcctccaacctccatccggatggcctctggtgattttaccgatacgcggcggccgcgggggagcgggctaccgtgctgctgctcctcgacggccaccatcttcgccgccgacttcatcgccgaccttcctggcgtcgccgtcggcagacagagagtcgtgccgatctcgtcgaccccgtcgacctgaccgacaagcaaaaccccaaatcaactaccattccgaacctaataggactcacgaacatactacacgagtggaatcgagaactcaccgaggt

SEQ ID NO: 577 - DNA, 1072 bp, Zea mays
  misc_feature (48)..(48): n is a, c, g, or t
  misc_feature (165)..(165): n is a, c, g, or t
  misc_feature (202)..(202): n is a, c, g, or t
  misc_feature (224)..(224): n is a, c, g, or t
  misc_feature (229)..(230): n is a, c, g, or t
  misc_feature (248)..(248): n is a, c, g, or t
  misc_feature (255)..(256): n is a, c, g, or t
  misc_feature (277)..(277): n is a, c, g, or t
  misc_feature (283)..(287): n is a, c, g, or t
  misc_feature (295)..(295): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (314)..(314): n is a, c, g, or t
  misc_feature (318)..(318): n is a, c, g, or t
  misc_feature (333)..(333): n is a, c, g, or t
  misc_feature (338)..(338): n is a, c, g, or t
  misc_feature (346)..(346): n is a, c, g, or t
  misc_feature (364)..(365): n is a, c, g, or t
  misc_feature (380)..(380): n is a, c, g, or t
  misc_feature (386)..(386): n is a, c, g, or t
  misc_feature (391)..(391): n is a, c, g, or t
  misc_feature (394)..(394): n is a, c, g, or t
  misc_feature (401)..(401): n is a, c, g, or t
  misc_feature (403)..(404): n is a, c, g, or t
  misc_feature (414)..(414): n is a, c, g, or t
  misc_feature (416)..(416): n is a, c, g, or t
  misc_feature (421)..(422): n is a, c, g, or t
  misc_feature (425)..(425): n is a, c, g, or t
  misc_feature (428)..(428): n is a, c, g, or t
  misc_feature (437)..(437): n is a, c, g, or t
  misc_feature (446)..(446): n is a, c, g, or t
  misc_feature (453)..(453): n is a, c, g, or t
  misc_feature (458)..(458): n is a, c, g, or t
  misc_feature (461)..(461): n is a, c, g, or t
  misc_feature (472)..(472): n is a, c, g, or t
  misc_feature (478)..(478): n is a, c, g, or t
  misc_feature (493)..(493): n is a, c, g, or t
  misc_feature (497)..(497): n is a, c, g, or t
  misc_feature (499)..(499): n is a, c, g, or t
  misc_feature (525)..(525): n is a, c, g, or t
  misc_feature (534)..(534): n is a, c, g, or t
  unsure (1)..(1072): unsure at all n locations
tcctcccaacaagctgaagatgctctttctcaagggatggaagcattncaacagtcgcttgcagaaactctagcatctggatccctgggccctgctggaccttctggcaatgttgcaaattacatgggacaaatggcgatggctatgggaaaacttggcaccctngagaactttctacgacaggtttgtcatgcaaaatcanggacttgctcatttcataacantgtgnnatctttattttccttaanttgctgnntactctttgaggtcttttatntagacnnnnncagctacntgatnttntnaaatccatntctntaagaataaaattgntgagnagcttatncaagcttaatctgaaatnncaaatgaattattgnaaaggnttacnatnatcaaangnntgtcgatagntnatganntanaanatcagtggnacagatttngatttgnagtgntcnctttagcaganatcttnatcaaaagaactttngcananatagcaaggaagtacaaatttttttnacaatgtcntctgcagccagatctagcacgtgcgagcagttggacgtttggatttactgtatgggtgaaccagcaatgggggcaatggcgagtggcgacggggtaccaaccgggagcagagatccatgtccgctcgcttggttgcgtcgggaccaatccaccaccaaggccaagccaatagccaagcagcggggggaccgaccgtgctgtcgatggcggattgcatgcacggaatgcagagatgcctacgggcacggctcttgtggtgcggtggtgtgtggagcttgacagcttgtggcttgctatctctgtgcctagcctagctagcagtagcaggcgcgcgagtgccaaaactgacggcagcaggtagctagtaggttggtcggctagggccatcgaggtgcgtcgccatccgacgcaggcaggaccaggaccaccgatgatggactggaatgatgatccgagtggaaataccggtaagtaggaccgtgaagaaaggtagcgacagtgtcagtgggatacccgtgatcattccgatgttttgaaa

SEQ ID NO: 578 - DNA, 525 bp, Zea mays
  misc_feature (43)..(46): n is a, c, g, or t
  misc_feature (51)..(51): n is a, c, g, or t
  misc_feature (69)..(69): n is a, c, g, or t
  misc_feature (233)..(233): n is a, c, g, or t
  misc_feature (282)..(282): n is a, c, g, or t
  unsure (1)..(525): unsure at all n locations
taaaataaagtaatttctgtggttgtaaattgtactaccttcnnnntcgantatctgtcgcccgcccgntagttcatatttgtcaatgctgcctttggcttgggcggagggaggctccccgcttcctggtgtctgcagatgtaatcagggtattgcctgatgctctctggtatccgccgatgtgatcatgagcttatcaatcaccttttattttctgattctgaaaacttganacttgaagccgatatattattcagtagtcgttttgtctgtcgaatgttnatcagtccctgcaaggatcacaccacgctgcgctctctgactgttttggcttcggcggagttgcggttcggttagtcagtttgcatagttcctcgttgcagatgatcgtagtttacaaaattctggtcgtgttcgtgttagttgttgtgccgctcttgctcggttgatggcaagatggcagctatatgtggaactgaactgccctgtcaaatcaaagccaaactgaatcaccaccaacaagca

SEQ ID NO: 579 - DNA, 694 bp, Zea mays
  misc_feature (564)..(564): n is a, c, g, or t
  misc_feature (642)..(642): n is a, c, g, or t
  misc_feature (664)..(664): n is a, c, g, or t
  misc_feature (673)..(674): n is a, c, g, or t
  misc_feature (676)..(676): n is a, c, g, or t
  misc_feature (684)..(684): n is a, c, g, or t
  misc_feature (687)..(687): n is a, c, g, or t
  misc_feature (692)..(692): n is a, c, g, or t
  unsure (1)..(694): unsure at all n locations
tccaacaagtggtttggagctttggtatttagtgggattctatttgggcgtcttgtatcatgatggttagctgatgaagcgtcatgtgcttgcatggtgggtccagtggaacctaagcaatattatgatgagatgctacaaacttttgtgtctgggctagcaaatgcggcgtggtacaggagtggagtggactttgtaagctgcttgatctttcaccgtcatcaaaccttggctatttaacgagcatatcaatcaatcatggtggtggtctgatgtaggacatgtgttacgatttccctagcagcttgctccttctcatcttttatttcaaatcttactgtgagtgcagctacggtacgtgttttgcacgatctattgactatagccttagggcatatacttgttttttttattacttctgtcaccatgagtggaggcaaaacactgctgtgttgttacataaaaacagacacacgtagatatttaagtgttaaatatgacatacggcttcttgcagaagcactcgttgccgatacaccgacgtgttcttttatttggctgagnacatactgatgctttcgttttggactgaacgcattttggaatcagacagcagcaaccatagcgtggtttggctacctncagttttgcatctgccccgtcntaaaattanntnaatgacgncanttacntt

SEQ ID NO: 580 - DNA, 732 bp, Zea mays
gacctgaatatttttcattgatactggcaagccggtggatggaggaggcctgggcacctacatttgttcgtactttggtccccaatgagttacattacaaaagaggataggaagagattaggccattattacgatttacgaacatgccacagccagcaccgtgactgcaataaacaaattccttgaggtcatcgtcgttcgatatagcgggaggatttcacctctgttatccgtgttgacatcaatttattctttttacgaacacaattttaatcccatcggctcgtcctaggcggggtgacgaagtatttcttgcacggaaccctgcatctcattgtgtgctgacgatggctcttctcccttagttctacgcctgcagcttgctgctacatctgcccttggtcactcacatttagaagtatgtgaaatcatgtttggagatctggcattatttgttgaggaggtgtcatcagaaactgaaggaaaacctaaatggaaggtacagaggcttaactttcttaagttaatgcatttgtgaaatttgtattgaattagttaggtattaatgcttatttcacagctttctttcaagggagatcataagtttcacagacctgcccatgttgctgcaaaaactaaacgttgcacttcacctttttttgagacatagtatagactatagacatactacctcttacgccccacccccaaatgatctactggagattggga

SEQ ID NO: 581 - DNA, 778 bp, Zea mays
tggtgaccatgtttacttttaaccaaggttaggggcggcaaatgatttgaaatcgaggtccaagcaatagcgtacacagataaggttaggttccccctgtatttactagtcagattaaagcatccttgtggagttggggttgtgggccacaacaacccaccaatacagcagtggaaggaaggaggagcgagagcagcggtgtcgacagtaccttcatcttggatttcttggcttgcagcttcttggcctgcttctccttggcctccttctcccctgcacaccaccaaatatcgattccaaatcaaggcgacgatcgaaattggacatgcaagggaaaggaggcaatacaagatggaatcgtacgttggaggtcgaactcgtactgcttcttcctcttggcaagattgttcttcttcgacatgttccctcccttgctgtcgccgccgaccggcacgacagcagccaagggaaggaggagacgcgagcaaaccctagccaaacacaacacaagccttcctttggcagtcagtcgaagagtaagtgggtcgttaaatctgggctagtggcgtcgttgcttgtcttcaggcccaggtactgcacatctggcccataccggaatggcagttaaatctctcttgcagttttgggcttgttctcgtgtacgcacgcatactactgcatgctttcgttgttttttttttttgctcaagggaaccgaactgtagtgaaaccattgtcctgtagaatgaatatgacctacctacctacgtacctattg

SEQ ID NO: 582 - DNA, 336 bp, Zea mays
  misc_feature (64)..(64): n is a, c, g, or t
  misc_feature (81)..(81): n is a, c, g, or t
  misc_feature (108)..(108): n is a, c, g, or t
  misc_feature (115)..(116): n is a, c, g, or t
  unsure (1)..(336): unsure at all n locations
ttcaaactcgggacctgataagtactactctgaccacctatcaactcagctagaggccctttcnccaaaattgatataaanaaaacgataaattgatcatttattganttttttnnctattcatgtgctatcttgactcaaactgcagccaaacttttgcattgttgataggaagtaccctgcagaattcactccgacatatgcatatcacgtacaataaaatcatagcagagtaaaagttatctaaagatgtattgaggatacaattaaaccttgtatggagttgctttaaaaactacaaatgctcagttatggtattccaatcctaaatctgca

SEQ ID NO: 583 - DNA, 661 bp, Zea mays
  misc_feature (208)..(208): n is a, c, g, or t
  misc_feature (285)..(285): n is a, c, g, or t
  misc_feature (358)..(358): n is a, c, g, or t
  misc_feature (490)..(491): n is a, c, g, or t
  misc_feature (568)..(570): n is a, c, g, or t
  misc_feature (591)..(592): n is a, c, g, or t
  misc_feature (601)..(602): n is a, c, g, or t
  misc_feature (605)..(605): n is a, c, g, or t
  misc_feature (617)..(620): n is a, c, g, or t
  misc_feature (623)..(623): n is a, c, g, or t
  misc_feature (627)..(630): n is a, c, g, or t
  misc_feature (639)..(647): n is a, c, g, or t
  misc_feature (651)..(652): n is a, c, g, or t
  unsure (1)..(661): unsure at all n locations
ctcgcggttctgctcggccagcctgtcacgcatcgcctgcgactcctccagcagcgaggcgtgcgagagcgccacggccacctggtcggcgaccacctccacgatctccagctcgtgcggcgcccacttcctgccgctgggcggcaccagaaccagcacggcgtagctggccttgatcacctggggcgtcccacccttgaagtcggcnaccctgagcatcggcattcggatcgccgccaccgtgccggtcccctccttgccgccgccgctggcggagccaagtancgagcccggcggcagcagcttgaccccgtcggcgcccttgacctcgaggacgtccgcgtcgtcagcgcccacnacggcctcgccgtcgtcgctgccccgccggagctcgtgtgtgaggcacattccggacttgtcctcggatggcatccagacggcgcagttgtcgagcgcgagcaccctggagagctcgatgagcgtggtgtanngcacggtgtggcggtccagcgagcggcggatctcctgggtgagcatgcggacgtgccagctcgcctcctcctgccgnnncatgagcaccacctcgcggtnnagctcgcgnnccntgatccacagcnnnntcncgcnnnncttgacgcnnnnnnnnngcgnnatgagcgtg

SEQ ID NO: 584 - DNA, 499 bp, Zea mays
  misc_feature (22)..(24): n is a, c, g, or t
  misc_feature (132)..(132): n is a, c, g, or t
  misc_feature (144)..(144): n is a, c, g, or t
  misc_feature (189)..(190): n is a, c, g, or t
  misc_feature (192)..(192): n is a, c, g, or t
  misc_feature (314)..(314): n is a, c, g, or t
  unsure (1)..(499): unsure at all n locations
ctccgtggcccgatgcatcatnnngtacaggttcgtctcacctgctttgccttttgcggtggcaagcaaaatcgaatagttgtagcatccaccaaagacttggaaatggaaatggcttccctgatttttttntcccaggttganagagagcattggcatcaccgttgccatttctcagtcttttttttnnantttttttgcttcctatggctacattcgctccgacagggcaaagacaaatagtagaaaataaactactatcttctactagaaaatccacgaaatgatagaaaagagtaacttcattggaaccnatcgatattttatctcgcttaggctgtcctcacgagatcgtttaaaatagaagatttatactctagattacattatttaagtttaaaataggtgataggatattatagatgcgggagacagtcttatgttttaccagcaacgagggattggagtggacagggccggctctatattttccaaaggc

SEQ ID NO: 585 - DNA, 653 bp, Zea mays
  misc_feature (565)..(565): n is a, c, g, or t
  misc_feature (580)..(581): n is a, c, g, or t
  misc_feature (589)..(593): n is a, c, g, or t
  misc_feature (597)..(598): n is a, c, g, or t
  misc_feature (601)..(601): n is a, c, g, or t
  misc_feature (610)..(614): n is a, c, g, or t
  misc_feature (620)..(622): n is a, c, g, or t
  misc_feature (625)..(625): n is a, c, g, or t
  misc_feature (628)..(628): n is a, c, g, or t
  misc_feature (630)..(634): n is a, c, g, or t
  misc_feature (638)..(638): n is a, c, g, or t
  misc_feature (640)..(645): n is a, c, g, or t
  misc_feature (649)..(649): n is a, c, g, or t
  misc_feature (651)..(651): n is a, c, g, or t
  unsure (1)..(653): unsure at all n locations
gaacgctgccctcccctgctccccgagcgcggcgaggatcgccgctccacggacgcaagaacaagtgcccttgatcttttccccccatttgattgattcatccagtgctgctggtactggtacccagcaacagttttcggtaggaaactactatggcaacttctccaggcaagttcgtttcgttcaaccagagaggattcaaatggttttcatccatccttctttcgtagggagtggaatcccgcttgggaaagtctctcgtccaaatggcatctgatccttgttcctgctctgctttcctctgcttcaggtacatacagatggtgctagtgagggagaggtccgcgagccgtcgccgccatttcggaccaaccaaggcggcgctagtatgcttctgcttgctttccttctacctggacactactgcaatgccgtcaacgtcattgtaaaccgtcagtgctagccacatggtaacgctagactgcgaaagttgcgatctttttctcgcatctcctcggcaacttgccaatttggtcagcatcgtcatcaccaccaccatcagcgncgcagctgaactgannatgctttnnnnnaganncgnatgctcatnnnnntcgagnnnccnttnannnnncccnannnnnntgcngntg

SEQ ID NO: 586 - DNA, 638 bp, Zea mays
  misc_feature (47)..(51): n is a, c, g, or t
  misc_feature (383)..(383): n is a, c, g, or t
  misc_feature (453)..(455): n is a, c, g, or t
  misc_feature (468)..(468): n is a, c, g, or t
  misc_feature (470)..(472): n is a, c, g, or t
  misc_feature (479)..(479): n is a, c, g, or t
  misc_feature (507)..(509): n is a, c, g, or t
  misc_feature (523)..(525): n is a, c, g, or t
  misc_feature (547)..(553): n is a, c, g, or t
  misc_feature (555)..(560): n is a, c, g, or t
  misc_feature (563)..(576): n is a, c, g, or t
  misc_feature (589)..(592): n is a, c, g, or t
  misc_feature (594)..(596): n is a, c, g, or t
  misc_feature (602)..(615): n is a, c, g, or t
  misc_feature (620)..(637): n is a, c, g, or t
  unsure (1)..(638): unsure at all n locations
atcttcacatatctctaaggcagtgtgtgtttctgccttgctttagnnnnnatgcaatttatcttgttcaaatttcttatcatctgccttctatatatctctttgcatggatattcaatcatttctttcttttgaaaacagtgggcctcctggagatctctttgtttgcctcgatatagaggagccatcagatatcaagagggatggtataaacttgtattcaactgtgtcaataagctatcttgaagctattttgggcaccattaagaaggtaagatatttcattatcagttgtgatctttaattagtttcagtcggcgatcactatcttgttcagtaaacagctagcttttcctcatacagcagaaaaatatctggtactnatccacttcacttgataactggagaacagaaacatgcaaaacttggtgtccttataagaaaaatagcctnnntactttattccantnnngatgcantcagcaaccttcaatttgatgtgtatgnnnagcccttttcgctnnnctttaacacaatatttgttgannnnnnntnnnnnnggnnnnnnnnnnnnnngattgctctttcnnnnannnaaagtnnnnnnnnnnnnnntttcnnnnnnnnnnnnnnnnnna

SEQ ID NO: 587 - DNA, 660 bp, Zea mays
  misc_feature (439)..(439): n is a, c, g, or t
  misc_feature (529)..(529): n is a, c, g, or t
  misc_feature (545)..(545): n is a, c, g, or t
  misc_feature (595)..(595): n is a, c, g, or t
  misc_feature (639)..(639): n is a, c, g, or t
  unsure (1)..(660): unsure at all n locations
cggaacagctcccttctaagcagacagcacaagggtcgatacaaacaggtgactggtttagatacctccatccacactccctagagaacgaaatgacacaattcattagatgttttctagacaagcaatgcaaaatggaccactatgataggctgacaagtgttggaactcatactacatggtcaggaaaacaatttaagggaaagcgttcataattaggcaactatagggagtatacagatgaacaagatcacatggcaacctataagaaacaatgagcagtaaccagtaaattactatttaagccatgcaggcgacaagaccagggaactaatggcacatagctgcataactaaattagagacatggtcacctggcaatgttcatgatactcatgagtggaagacagagataaggtgaaggaagagtgtgtatccgnccctctggttctctacttaagatttcttcaactgaatttctttgccaggaacgagccaccattaaaggggtccatctgcataacagaaangaacatgtacttaganaaatcatagtgctaacaacaatagcaaaggctatttgccatgtggcagangttgggaatcgcacccgctagcattttgcacagcaatgcaagcncctcgagcaattaggagctgc

SEQ ID NO: 588 - DNA, 660 bp, Zea mays; identical to SEQ ID NO: 587
  misc_feature (439)..(439): n is a, c, g, or t
  misc_feature (529)..(529): n is a, c, g, or t
  misc_feature (545)..(545): n is a, c, g, or t
  misc_feature (595)..(595): n is a, c, g, or t
  misc_feature (639)..(639): n is a, c, g, or t
  unsure (1)..(660): unsure at all n locations

SEQ ID NO: 589 - DNA, 597 bp, Zea mays
  misc_feature (79)..(80): n is a, c, g, or t
  misc_feature (83)..(83): n is a, c, g, or t
  misc_feature (88)..(88): n is a, c, g, or t
  misc_feature (245)..(249): n is a, c, g, or t
  unsure (1)..(597): unsure at all n locations
gcagggagctggggctggagccccggcagatcaagttctggttccagaaccgccggacgcagatgaaggtgtgtagttnnacngcacnttgccattcttttaccttctctccctctcagtcgtcccttggtggtgtggtgttggtcctctgtttggttcgcgcccgatcctgttcgagatgacggccattaacttgggtgtcggttgtttgtttgttaatttggccgctggacggggtgtgtacnnnnngtactgcgcaggcgcagcacgagcgccaggacaactgcttcctgcgcgcggagaacgacaagatccggtgcgagaacatcgccatgcgggaggcgctccggagcgtcatctgccccacctgcggcggcccgcccgtcgccgacgactacttcgacgagcagaagctgcgcatggagaacgcgcgactcaaagaagaggcaagccgtttcgcattcaccgttgcgcttgcgccccgccattggtgtatttgtaccgcgctctcgtttcacacgcgcgtttcatgcggtatgggcagcttgaccgggtgtccagcctgacgtccaagtacctggggcggcccatcacgca

SEQ ID NO: 590 - DNA, 561 bp, Zea mays
tgggtaaggataaccctcctgatctagcacatttggttccaactggcgtgccaaattcttcagaacaaccagttgagaacacggcacctactaatgttcttaaagagacaggtcagcttttcatgcatgcaatactttaagatttcatccccttgcagttatttgctttatcatctatcgataggccatgctggcatttttttgcatcaacaaaattcacgtgattcgatgacccttctgtgcatgccccacatttgtttggatgactgtctagccgagaaaagtttttcttcagtatgtacttattatatcatatataacagggtaaaataagtgtttggtagcattagcatgcccttctttttgaatctgaattatgctctcatggtcatggctggcaagagctctgtattttaatatggttcgaaagtaggtaggaatttcttatgggtaacgtaaatgtttaccattgccattagagcaaactaacacttagcttgtgacctttcagtccacaatgcacataatgttgtccaacacaaacatagcgatcatgtagca

SEQ ID NO: 591 - DNA, 554 bp, Zea mays
ggctcggtcgtgtacgtcaacttcggcagcatcacggtcatgacgcccgctcagctcgccgagttcgcgtgggggctggcgaactgcggcaggccgttcctgtgggtcatcaggccggacctcgtcacgggcgagaaggctatgctgccggaggagttctacgctgagacgagagagagagggctcttcctcagctggtgcccgcaggaacaggtcctgtcgcatccgtccaccgggctgttcctgacgcactctgggtggaactctacgctggagagcatacgcgccggcgtgccgatgatctgctggccgttcttcgcagagcagacgaccaactgccgatatgcctgcgcgaactggggcattggactggagatcgacaacaatgtcacgagggacgaggtggcacggctcatagaagaagccatggacggcgagaaaggcaaagacatgaaggcgaaggcaacagtgtggaaggagaaggccgtggcagcaacagaaagcggcgggacctcgagcgtcagcattgatcgtttggtcgagttcctgcttga

SEQ ID NO: 592 - DNA, 470 bp, Zea mays
  misc_feature (156)..(157): n is a, c, g, or t
  misc_feature (159)..(159): n is a, c, g, or t
  unsure (1)..(470): unsure at all n locations
agcaaaagtacaaaacatacgagaggctctctcatctctacggcgtatgtgaatgccttgttccctctctacctacaccagcaccccccctggactctagggtcttgcatgaactggattgcagcgctggctcgcgggacgctgccagttattttnntngtctttatggaccaagtagtgtgcgtgttttgttgttccattcagcaactacttgactaaaccataatcctccagcggccaaactaaatttaagatgtttgaaccaatcaaaaactcctagagcggtgaggagcacacctgaagcgtaccacaattagagtagacgtctagtgatccttctcctcttgcttgtggaagaactatggtaacatactgcaggagacccgacagtagcgtcatcgctttgttgactcagacaggctgcagcgtccaggacacctattgggctttgtggcacagaggagattgat

SEQ ID NO: 593 - DNA, 486 bp, Zea mays
  misc_feature (1)..(11): n is a, c, g, or t
  misc_feature (326)..(326): n is a, c, g, or t
  misc_feature (331)..(331): n is a, c, g, or t
  unsure (1)..(486): unsure at all n locations
nnnnnnnnnnncatcaatctcctctgtgccacaaagcccaataggtgtcctggacgctgcagcctgtctgagtcaacaaagcgatgacgctactgtcgggtctcctgcagtatgttaccatagttcttccacaagcaagaggagaaggatcactagacgtctactctaattgtggtacgcttcaggtgtgctcctcaccgctctaggagtttttgattggttcaaacatcttaaatttagtttggccgctggaggattatggtttagtcaagtagttgctgaatggaacaacaaaacacgcacactacttggtccataaagacaanaaaantaacaggcagcgtcccgcgagccagcgctgcaatccagttcatgcaagaccctagagtccagggggggtgctggtgtaggtagagagggaacaaggcattcacatacgccgtagagatgagagagcctctcgtatgttttgtacttttgctcctt

SEQ ID NO: 594 - DNA, 466 bp, Zea mays
  misc_feature (1)..(1): n is a, c, g, or t
  misc_feature (309)..(310): n is a, c, g, or t
  misc_feature (314)..(314): n is a, c, g, or t
  unsure (1)..(466): unsure at all n locations
nctcctctgtgccacaaagcccaataggtgtcctggacgctgcagcctgtctgagtcaacaaagcgatgacgctactgtcgggtctcctgcagtatgttaccatagttcttccacaagcaagaggagaaggatcactagacgtctactctaattgtggtacgcttcaggtgtgctcctcaccgctctaggagtttttgattggttcaaacatcttaaatttagtttggccgctggaggattatggtttagtcaagtagttgctgaatggaacaacaaaacacgcacactacttggtccataaagacaannaaantaacaggcagcgtcccgcgagccagcgctgcaatccagttcatgcaagaccctagagtccagggggggtgctggtgtaggtagagagggaacaaggcattcacatacgccgtagagatgagagagcctctcgtatgttttgtacttttgctc

SEQ ID NO: 595 - DNA, 890 bp, Zea mays
  misc_feature (136)..(136): n is a, c, g, or t
  misc_feature (431)..(433): n is a, c, g, or t
  misc_feature (476)..(478): n is a, c, g, or t
  misc_feature (499)..(507): n is a, c, g, or t
  misc_feature (829)..(830): n is a, c, g, or t
  unsure (1)..(890): unsure at all n locations
aggaatgccatgacacgcaactggtgacagcaaccgatggtggatggatggacatgccgtcgacctttccgctaattaccaacctgtcctctaagcaactggtgacagcgagcaatccagaacggatagagtatancacttcacttgctttgttttagcacgtagtagtatttttttcccctatatctcgttgtgtatgtatgatgatgacgagtggatctttagctggtgtctggctggctggttgcggcacagcgaatggatgtcgtgcaggatcggagccaccggacccctttgtttatcgttgctgctatgctcattgctccgcattgtttagtacgcgtcggcacgaagcttgccgcggcgcgacacgcgcaaaaggtaaattaatctcgcggcgaggcaaaatcgctttgcccggagcccccccnnngacgggcgacggcgccgggagggaggacggacgtgaactgctnnncctcccggtggctggctggcnnnnnnnnngcgacgccattacttggtcttgtacacatcatgtccgtagtcgagctgtccatcttacttgcaataccatgctgggcctacggtgcggtgtggtgcagctaagcttaggggatcgttagtggattctcgagtgctgcgtatcacggcgaacaacatgtgatgcgatcagaccagagtttcgtacgtcgtgtggtgtcagtacatggaggatggaatcacggaaatggctgtactatatatcctcagaatctgcgttttttgttacaccattgtcttatgtatacagcggccgggcctacggggttcactttgcgctctgttnnaaaattctgcctcgaccacaactccagatgcagactggccattagcgtgcgtgctggatt

SEQ ID NO: 596 - DNA, 799 bp, Zea mays
  misc_feature (76)..(76): n is a, c, g, or t
  misc_feature (92)..(92): n is a, c, g, or t
  misc_feature (122)..(122): n is a, c, g, or t
  misc_feature (373)..(373): n is a, c, g, or t
  misc_feature (514)..(514): n is a, c, g, or t
  misc_feature (552)..(553): n is a, c, g, or t
  misc_feature (674)..(675): n is a, c, g, or t
  misc_feature (677)..(677): n is a, c, g, or t
  misc_feature (684)..(686): n is a, c, g, or t
  misc_feature (735)..(738): n is a, c, g, or t
  misc_feature (742)..(785): n is a, c, g, or t
  misc_feature (790)..(793): n is a, c, g, or t
  misc_feature (796)..(798): n is a, c, g, or t
  unsure (1)..(799): unsure at all n locations
aagagcgtttggaacagaactcactaacattgacatgcatacaagtaatctagattcaaaaaataagaagaaagcnaaacttgtacagagtngtggtgatgtcttgacgaattgcaaattanctgtgcgtagtcggctggggcagggtaaacaaagtggctttgtttatggtcctttccacccttctggcgcaaggaaacatggacttgatggcggcaataagcctgggcaaagggagagggctgaggactgggagagcctttctgcttcatttcgaccacagtaccagaaccaaggtgggttcagtacttcaatcctgttttgttccttaggacaaaactatggtttttctacttgagcatcggaagtatgngtatagcatgtctgtctagctgtagttttatataattaggattaagctaattatataactatggtcaaacaggattggcatctgatggtcttcagatggaatcactctgccaatcctgtttaatcatgtaagctttggcancccctgttgcaactacagctagagagacatgtcagctnnaaagtctgaaaatgaaatttgacctcaggagaacactgcaacgcatctctagcgtgacatcattatcttctatttagaacctaatatgatatttgttgagtttttataagctattatgcannanacttgannntgcccaatagttcattatgatcatttgacatttatcatcacttctatgnnnnctcnnnnnnnnnnnnnnnnnnnnnnnnnnnnnnnnnnnnnnnnnnnnaaaannnnaannnc

SEQ ID NO: 597 - DNA, 567 bp, Zea mays
  misc_feature (4)..(4): n is a, c, g, or t
  misc_feature (19)..(20): n is a, c, g, or t
  misc_feature (131)..(131): n is a, c, g, or t
  misc_feature (371)..(371): n is a, c, g, or t
  misc_feature (376)..(376): n is a, c, g, or t
  unsure (1)..(567): unsure at all n locations
atcnacctcaggtatactnngtgttgtgcaaccagttacttccacagaacgcccccaagtcagaacatgtcagctcaaactcacacattatcccaggagataatcacattccaaaggctctgttatagatntcatttgaacccagcatgtgcaacttgttcacttcacttggatataatatcctcgacatgtctgacataggagtgctattcccttgtctcgaatcactccacccatcccagtgaccatttgtaacctgcgagtttctgggttgttgcggaatctgcacataaggggatagaggaccatggttctgacctaaaaatctattatcattcatatggttcaaaccatcctgcatatggtctgcnaatcncatgttttggtgagactgcacatttggctgtatatgtaagtgaaatcttggatcactgcttgctggttgcaactgtgcttgaaaagcaggagtatttttcatctccagccctgaatcgccaattccaggcatcagccctttgcccacagctaatatagcaggatcatcgaactccatgtcacttgagtgcc

SEQ ID NO: 598 - DNA, 724 bp, Zea mays
  misc_feature (48)..(48): n is a, c, g, or t
  misc_feature (290)..(290): n is a, c, g, or t
  misc_feature (402)..(402): n is a, c, g, or t
  misc_feature (627)..(627): n is a, c, g, or t
  misc_feature (653)..(653): n is a, c, g, or t
  unsure (1)..(724): unsure at all n locations
ttaagctctgctacaggtcccagtaatgcagaactaaagaaacttccngaatcaacaatttacaactggagttgtggtcacttctctaggccacttttaactgcctctgatgataatgaagaaaccaatgctagaagagaagagagagaacggattgcactagatttcatcactaagtgccagcgctcctgtacgtggatgtacatttgtctgcattacattattgttgttggttttcttgattgtttacctgctgtttttcttggtggttcaacctgggaatagcagcntgcaagattacaagccaaattgctagttgggatacaagatttgagttggggacaaaggcagctttattattgccattttctccgattgtcgtagcagctgatgaaaatgaanaaataaggtgaaattattattgcaattaaaaatcctagtgcctgaatgcctaatacggactgctacaattgtgctgaagttctgtatcatgccagtgtgtggaactatgacgatgcacaaccagtgaactcttttcacaaccataagttgtccgacagagggctatctaaacttttgcttatcaacgagcttgatgagtgcttgcttttggctgcctcaagtacncctcttttctctatgttctatacttntgccattgcactgtctaatttttacattgcaggtgatggaaatgtacgcatatggaaaaattttgcttgta

SEQ ID NO: 599 - DNA, 1049 bp, Zea mays
  misc_feature (554)..(554): n is a, c, g, or t
  misc_feature (592)..(592): n is a, c, g, or t
  misc_feature (1038)..(1044): n is a, c, g, or t
  unsure (1)..(1049): unsure at all n locations
atagtggtgtaacccatgccgagcatccggaggagggcaagtgctccttagctgatgatggaaatatccagaagtctggggttatggtcaaagaaaaagagacacatggacaaaacgctggggctagtttggatttaactgaaagagttgagaatgttgacactggtgaaaaggcgagcggaggtaaaatcggtgatattggcactagtcaactgagcatgacactgtatgagaaaagtcaggctgctcacagggaggagaggccacgcaggtatgaaggcgtgcatgttgagtctcacaaagctctgatcgaagagttggagaggtctctttcgttcagcagtgaggatgaatacttctcggacgaagcagaaagcagtggcctcagtgatgctctgcgtaaccaaatgggtagccgcaggtttatgctagggggcagagtgaatgatgcgccccgaagcgatccacatggtcgattgattgaagaactagagatgtctttcagcgatgcagaagagccattggagcagcatgctatgggttcagagagagtncatggaaatgtgcttgacaaggatccacagatcctgantgataaaagtgcacatccatgtgaagaaagcctctcatcatttgagagtggacacctcaaatctgaacaaactcctcaccaggaaagcagggcaataggggcaataggcaatggcaatcaaggaaatgagcgtattgaagataacaataatactgccgactctgttcatgggagtgagcatattgtgattgacgatgacaaaattgcagatatattccacgagaaagaacatgataaggattgccagcttgcaaacatagaaagtgcatacccttctgaaggaagcacctctgctgtcgatgattgcagtattgaagttcagcaaagttttcaaccaaatgacctgacagcagtcgatgagtgcagtattgaagttcagcaaagttttcaaccaaatgacctgacagcagatgtcaatcaagaaatggaagatgataagataaccnnnnnnnacata

SEQ ID NO: 600 - DNA, 1084 bp, Zea mays
  misc_feature (1)..(1): n is a, c, g, or t
  misc_feature (98)..(98): n is a, c, g, or t
  misc_feature (150)..(153): n is a, c, g, or t
  misc_feature (156)..(156): n is a, c, g, or t
  misc_feature (158)..(158): n is a, c, g, or t
  misc_feature (160)..(161): n is a, c, g, or t
  misc_feature (163)..(165): n is a, c, g, or t
  misc_feature (220)..(220): n is a, c, g, or t
  misc_feature (253)..(253): n is a, c, g, or t
  misc_feature (255)..(255): n is a, c, g, or t
  misc_feature (281)..(281): n is a, c, g, or t
  misc_feature (291)..(292): n is a, c, g, or t
  misc_feature (427)..(430): n is a, c, g, or t
  misc_feature (528)..(531): n is a, c, g, or t
  misc_feature (534)..(534): n is a, c, g, or t
  misc_feature (544)..(549): n is a, c, g, or t
  misc_feature (553)..(556): n is a, c, g, or t
  misc_feature (584)..(585): n is a, c, g, or t
  misc_feature (589)..(590): n is a, c, g, or t
  misc_feature (601)..(639): n is a, c, g, or t
  misc_feature (641)..(648): n is a, c, g, or t
  misc_feature (651)..(700): n is a, c, g, or t
  misc_feature (703)..(704): n is a, c, g, or t
  misc_feature (706)..(706): n is a, c, g, or t
  misc_feature (708)..(708): n is a, c, g, or t
  misc_feature (711)..(721): n is a, c, g, or t
  misc_feature (727)..(727): n is a, c, g, or t
  misc_feature (729)..(729): n is a, c, g, or t
  misc_feature (731)..(731): n is a, c, g, or t
  misc_feature (736)..(747): n is a, c, g, or t
  misc_feature (751)..(755): n is a, c, g, or t
  misc_feature (757)..(757): n is a, c, g, or t
  misc_feature (759)..(767): n is a, c, g, or t
  misc_feature (774)..(780): n is a, c, g, or t
  misc_feature (782)..(784): n is a, c, g, or t
  misc_feature (789)..(793): n is a, c, g, or t
  misc_feature (804)..(804): n is a, c, g, or t
  misc_feature (806)..(810): n is a, c, g, or t
  misc_feature (918)..(919): n is a, c, g, or t
  unsure (1)..(1084): unsure at all n locations
nccgcccctagacagagggagagggagtatgtcataggaaagtctaaatatagacataaaacttcattccctacttaagtgaaatgcagagctattgnaaacgtgtttaaaaaaacaaagtctagacacgttacatcagcattctagacnnnntanangnncnnncgttttgtacgacgtggttttgtgtctattttcgaagtactttctgcacatgctnttttacttttcttacccccacactcatgccctntnccttctcttgccacaactcttggtgncgtagtacgnntggctgactgcatatattcaattcaacaaaaggacacttgttcgcttcgatttctcactccttcatgcccataatatatcttcagagaccagtagtggcgacttcatcgaggcggtaaacccaaacgcattcgcnnnnatttcaacatctgtgagctctgtcaggtattccggcatgtcaggcaccatgaacaagtccccaaagctctcatcctgaactccatgggcatacgacgnnnngcngctgctgctnnnnnngacnnnnggcacgccgccgtcgtcatgcgttgctnnctcnncgacgacattnnnnnnnnnnnnnnnnnnnnnnnnnnnnnnnnnnnnnnncnnnnnnnngtnnnnnnnnnnnnnnnnnnnnnnnnnnnnnnnnnnnnnnnnnnnnnnnnnntgnngnantgnnnnnnnnnnngggcancntngctcnnnnnnnnnnnnacannnnnantnnnnnnnnnttaaacnnnnnnncnnncatcnnnnnccttttttaantnnnnntatatcgaaaataagattactactttattttgggctgaaatagatgagaaatttgatacccaaaattcaatatagaaatcgaacatacactaaatgcatacatcagtnnagatgttttctttccatacatacaaacatacgtacctagaatgctttgctttggagatccacttctgcccgtactttctccactgatacccatcaaagtttggtgcttgtgtcacaactgaactcactacgtgttttgcattcttcctaccattaccaagagaaa

SEQ ID NO: 601 - DNA, 663 bp, Zea mays
  misc_feature (365)..(484): n is a, c, g, or t
  misc_feature (572)..(573): n is a, c, g, or t
  misc_feature (585)..(585): n is a, c, g, or t
  misc_feature (605)..(611): n is a, c, g, or t
  misc_feature (619)..(619): n is a, c, g, or t
  misc_feature (629)..(629): n is a, c, g, or t
  misc_feature (632)..(632): n is a, c, g, or t
  misc_feature (634)..(639): n is a, c, g, or t
  misc_feature (641)..(646): n is a, c, g, or t
  misc_feature (648)..(658): n is a, c, g, or t
  unsure (1)..(663): unsure at all n locations
ataccttgctatttgagaattgaactattcgcctagatgtgggaagaaaatgagatactcttgttccagttccagatccagtatcatcaactttctgaccatgtccactactgaactgcctttgtagtgacgagtggttatgtgcatcagatgatctctctctaacacaaagaagcatccgtcctatcatgaagcaatacccgatcagcatgagaaatgacaaattcactgtccccaagtgttgttctaaactagaaatgggtactacaacataagctttatactgcatgcagtctcggaaaaaaaaacaatagtggaatgcccatcccttaaacatttactaatataacacttggttcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgacgccttaagaacagtgttcacaatgattttcaaatgagcaaatcagctgaggaaatcttctgaacagtacagtgacaaaagnngtttttggtagncctaaagtcaattgcaacannnnnnnacagctangataattcantanannnnnncnnnnnncnnnnnnnnnnnaccta

SEQ ID NO: 602 - DNA, 854 bp, Zea mays
tgcctgcagccattccccgcgtccatgggtggcggaggacgggagagaggggaggcgcgggggcgcgtctacggttccttgcgcgtgtgtaggtgcgcgccgctggatctgggggggctagggacgagaggctgtcgccatgcgaggaggaggagccggcggggaggagaggaggtgtggtcgcggcgaggtggaggcgggggcaggacggaatgctctggtggtgctggtacctcacctgtccgcgcctccggggcaaaagaagaaaacgagagaagagggggcgaatatgcgtagcggaattctacaccgttcggtctctggctgccatgtggggtcaacatgtcagtaggcgtctcgaatgcacaggcagcacagccgtccatcctaccgaaactcgtcgaatttgatttgattcgatccagtgtttttgttatcttttttttaaaaaaaatatatttattatttttcttagaaatgaccagaactcgagtgatcttagaacatcttggcaattcttgcattttacatgatagagtataagaataatgttatcgcaatggatcgcatcgtatctgttggaacaatggaccgcaatccgagaccgtcaaagtcaaactgcttctgccggctggcatcgtccgccggataccgacgcgagacagccatccagattctctcatctatgccggtcttgtcttctagaacaagatgaatttacagcaaaacacgtgtgtacaatacaggcgcaacgccgagctcgctcacatcacatcactgctagacagcttgagggccatctctgcctgaagcctggtaagttcgcttacatcactgccctgtctagaaaaccc

SEQ ID NO: 603 - DNA, 687 bp, Zea mays
  misc_feature (39)..(39): n is a, c, g, or t
  misc_feature (55)..(62): n is a, c, g, or t
  misc_feature (74)..(74): n is a, c, g, or t
  misc_feature (171)..(171): n is a, c, g, or t
  misc_feature (555)..(586): n is a, c, g, or t
  misc_feature (662)..(663): n is a, c, g, or t
  misc_feature (674)..(674): n is a, c, g, or t
  misc_feature (678)..(678): n is a, c, g, or t
  misc_feature (680)..(684): n is a, c, g, or t
  unsure (1)..(687): unsure at all n locations
agatattaacttactaccttagatttctttttttttttngaggaaattgctaccnnnnnnnnacctttcatacngggtgtgcttccgtaccctccatctccttgcgtgcagactctagagatgctggagaagaaggagcgtttcctccagaagaaatgttccgcggaaatngagaaggcgaaggattacacaaaagcgaagaacaagaacggtaaggaagagccaacacatccgccattcttatgttccgctacacgcctacaccacaaccttagtttgtcaaatatgcaaattttgcctgcttacctttcttaaactatactagcttttcgctctctcaaaaaatagctatttcgctcgtacgtgagatttcttccgtgtttgtttcgtttcagccgcaatccagtgcctaaagaagaagaaactgtacgagacacagatcgagcagctatcgaatttccagctgcgagtccatgaccaggtaaaaggaaacacatacatgcaatgcaaacggcgcacgtctcggagcttgatagattgatagtaagttgtttnnnnnnnnnnnnnnnnnnnnnnnnnnnnnnnngatcataatgctcgaaagcgccaaggcgaccacggacactgtcgacgctctgcgctcggggtcatctgctgtcaanncgatgcagcantcantnnnnncta

SEQ ID NO: 604 - DNA, 628 bp, Zea mays
  misc_feature (467)..(467): n is a, c, g, or t
  misc_feature (469)..(469): n is a, c, g, or t
  misc_feature (502)..(502): n is a, c, g, or t
  misc_feature (526)..(526): n is a, c, g, or t
  misc_feature (552)..(553): n is a, c, g, or t
  misc_feature (560)..(561): n is a, c, g, or t
  misc_feature (569)..(579): n is a, c, g, or t
  misc_feature (581)..(584): n is a, c, g, or t
  misc_feature (586)..(614): n is a, c, g, or t
  misc_feature (617)..(617): n is a, c, g, or t
  misc_feature (619)..(619): n is a, c, g, or t
  misc_feature (622)..(626): n is a, c, g, or t
  unsure (1)..(628): unsure at all n locations
caagaacctttccaagaccttgaaggacgtcgtctggaaatccgacgatcttcaaacgcaacatgcttcttagcagaacctcagagaggaggaatggcaaactattttgtgcaccatcctttcaagcaaactattctgcatgtaacggtgggtgcccaggaaattgcgctggtgctccaccatcgttgtatatgctgcgtcttgagttgcttgctgtagctgaagggaagttcattcagtaggttttgagtatgagttttgtatatccgtatatgcctatgactatgagccgtgctggaacactatgatcagaaactgcgaaatggagcccagaatgttcttgccatcttgctccagttctcagcaccgggcttaacttgccttgcattttttgaagaagaaaaatggactactgaattgggaactcgtattagtactcggccatcatttcagtagtcttttttttngntaccatgtacaccgcgaatcatgcaggttcttnctttgcttgctgttagttacattnggttctcctgacagctagaaactaanntggcagnntgagtagnnnnnnnnnnnannnnannnnnnnnnnnnnnnnnnnnnnnnnnnnntgncncannnnnat

SEQ ID NO: 605 - DNA, 707 bp, Zea mays
  misc_feature (563)..(564): n is a, c, g, or t
  misc_feature (607)..(608): n is a, c, g, or t
  misc_feature (614)..(617): n is a, c, g, or t
  misc_feature (629)..(634): n is a, c, g, or t
  misc_feature (638)..(646): n is a, c, g, or t
  misc_feature (650)..(652): n is a, c, g, or t
  misc_feature (655)..(704): n is a, c, g, or t
  unsure (1)..(707): unsure at all n locations
atcgccaagtacaggcccaccatgcctgttctttctgttgtcattcctcgtctgaagacaaaccaactgagatggagtttcactggtgcttttgaggtacgtgaaccccaatattctttgtgatctttcctgttagatgttttctttttatgcaacactgacattatctattattagcatgttgatcatttcttttgtgaatggtaacattggtctttgaagtttctcttgtagatattgaacatgtgtcatgcaatgcttaagagagattactttatttgagaagaattaagaaccttgattgccttctcttgtactgatacttggcaccatgcaactcatttgttgtttctttttcttgcaggcaagacagtcgctgatagttagaggcctctttccgatgcttgcagatcctcggcatccagtaagttaactgaagtctttcagttcactactttgtataagcaacacatactggctgcactgctcacttgtacacatgagcaactcatttctagcatcgttggggatggaaagattttgcaaacacatccccattgccnntgtattcttggacaagcattttttttattcatctattttggtnngatatnnnntgaaaacttgannnnnnttgnnnnnnnnnatgnnnctnnnnnnnnnnnnnnnnnnnnnnnnnnnnnnnnnnnnnnnnnnnnnnnnnntca

SEQ ID NO: 606 - DNA, 506 bp, Zea mays
acggtgacctcagagccatcgtcgacgacgccctcacccaccacgacgagctgttccagctcaaggccatggcggccaaatccgacgtgttccacctcatcactggggtgtggacgacccccgccgagcgctgcttcctctggatgggtggattcaggccctccgatctgctcaaggtatggattcgtttcagtactctgaaatagaacatcagatatcaaaaaaaatgtgtgcatgcacaaggtaggctgacactgactggagcagggaactcaggcggtgttactttttcattactaagatcacaagaactgttccaatgtaaatcagatttccccttagtacaagaagaatttgcagttccaataaagtatacgaaattccattctgttgcagacactgctgccccagctagatccactgacagagcagcaagtggtcggcatatgcagccttcagcagtcatcacagcaggcagaggaagctctctcgcagggcttggagca

SEQ ID NO: 607 - DNA, 799 bp, Zea mays
  misc_feature (432)..(432): n is a, c, g, or t
  misc_feature (519)..(519): n is a, c, g, or t
  misc_feature (544)..(563): n is a, c, g, or t
  misc_feature (575)..(575): n is a, c, g, or t
  misc_feature (731)..(731): n is a, c, g, or t
  misc_feature (770)..(770): n is a, c, g, or t
  unsure (1)..(799): unsure at all n locations
gccaccggtgcgccccgaacgcggcgccgctgaggatgaggtcgcggtagagcaggtggatgggaaccctgtcctcgatctccatgtgctccacccatgtcacctgatcaatgaaaatgtcacgcgagccacgactccgtaccatgcatacacccacgcatacgtgcacatgcacgtgcagcggcaacgcacacaaaatgccaatggcaattggcaagacaaaaaaaatgcacttttaacgacagcaccttggaggagccgtcggccatatcggcgatgaggcatcccgacgggaggcggcacgagcgcgacggcggcgcgccgaacctcgcgtcgtgctgctgcagcatctagcaggtcgccccgtctggctccacgctacccgccccgctcccgccatgtctgacgatagcgacaggcagcggcaatgcngccggggcgtcaccgtcgacgtcgagctcgacgccgccatggcgctcgccgacatggccggggtcgggccgcccggcggagatcagnacccgccggtgcagctcgcccctcnnnnnnnnnnnnnnnnnnnncaggtgaattgnatgaatggttaaaaccactgtcgccgtcgccgctctaatttgctcgatctagtaacataaccgttattaattaacataattgttcatgatcgtggatgcaccgactaggaggacgaggaggagctggcgagcacgcggctgagcctggagctgggnaaggtgggcatccaggcctccccgtgctccagcagctcnagcgccggcggcggaccgcatgcgcacca

SEQ ID NO: 608 - DNA, 644 bp, Zea mays
  misc_feature (18)..(18): n is a, c, g, or t
  misc_feature (29)..(29): n is a, c, g, or t
  misc_feature (131)..(131): n is a, c, g, or t
  misc_feature (141)..(142): n is a, c, g, or t
  misc_feature (262)..(262): n is a, c, g, or t
  misc_feature (314)..(338): n is a, c, g, or t
  misc_feature (373)..(373): n is a, c, g, or t
  unsure (1)..(644): unsure at all n locations
cgttagcgaagggccaangccttgttgcnctagcttgttcggcgtcactagacgatcgaggaacaaagaaccatccggcatttacagacgtcaatcatcttatcgtcaccgttaattattgcaaactcacngttaatatannatcgatttaaacaccgtacctgttgcacctgaggctcagcgcgaggccgccgtccggcacgacgatggggtgcagctcccagacagcctcaagagatggctgccctgctctggacttcanataagcctggttgttcccaaaccctagcaaccagaacctgtccaggcctctnnnnnnnnnnnnnnnnnnnnnnnnngcagcagcggacaccaagctgcccacttccatganggcgtgctcgacggggcagtagcagccctggccgtgatcacggccgccactgccgctgctcctccttctcgtctctgacacggcggcccaggcctcggcggcgtacgcgaggtcctcgaggacgagcacgacgcccttcccggcggcgcagccctggcggacgagcgcgcgcaggtcggcggccttggcctccacctcctccctcggcatccgctggaaggacgcggccgagaggggcacgaactggacgttcttgagccgctcgtgccgc

SEQ ID NO: 609 - DNA, 678 bp, Zea mays
  misc_feature (5)..(5): n is a, c, g, or t
  misc_feature (40)..(40): n is a, c, g, or t
  misc_feature (60)..(60): n is a, c, g, or t
  misc_feature (77)..(77): n is a, c, g, or t
  misc_feature (124)..(124): n is a, c, g, or t
  misc_feature (144)..(144): n is a, c, g, or t
  misc_feature (306)..(306): n is a, c, g, or t
  misc_feature (332)..(332): n is a, c, g, or t
  misc_feature (538)..(538): n is a, c, g, or t
  misc_feature (576)..(576): n is a, c, g, or t
  misc_feature (580)..(581): n is a, c, g, or t
  misc_feature (583)..(584): n is a, c, g, or t
  misc_feature (591)..(591): n is a, c, g, or t
  misc_feature (624)..(630): n is a, c, g, or t
  misc_feature (633)..(633): n is a, c, g, or t
  misc_feature (654)..(654): n is a, c, g, or t
  misc_feature (658)..(658): n is a, c, g, or t
  misc_feature (660)..(663): n is a, c, g, or t
  misc_feature (670)..(672): n is a, c, g, or t
  unsure (1)..(678): unsure at all n locations
gaagncattgtttcttttatatggtggcaaataaatgccnctgaacgaacgaaatgtgcngccaaagagacgtcagnatataccttttcaggtttcttgacatcatcaagcagtcttggaatgntttccaccgcttccgggttngagaacaggaatgatctgaaacatatacaaaagattacatgaaattgcagtggaaatcaacggacgagttcttttctgcctggtgggcatgatagggttgtgagaaaacatacattgtctggtcattcctaatgtccggtagatctctcatcaccgatgaanggaagaaaccggagcttgtatctttntcgtcgacaggtgacaaccaccctccaagctcactatatatgtcgaacgaaattttggattcagtcttctaagttgctcaaaaataaaagagatgcctgcactgcatcaacgtagtgtcaaggttcagacttggtcgtacctggtagatggatctaaccaaagctttttcgatgaacagtcaaatgccttcgaaaatgctgaaccntttggcacagtagtgtttgagttcctcatgaagatctnctcnngnngaactgngttcctattgatctcatgcacctataaaacacnnnnnnngtnaaatcacccgcgcgtgcaacntatncnnnntaaaatnnnaaattt

SEQ ID NO: 610 - DNA, 645 bp, Zea mays
  misc_feature (247)..(248): n is a, c, g, or t
  misc_feature (510)..(510): n is a, c, g, or t
  misc_feature (515)..(519): n is a, c, g, or t
  misc_feature (521)..(521): n is a, c, g, or t
  misc_feature (543)..(543): n is a, c, g, or t
  misc_feature (551)..(563): n is a, c, g, or t
  misc_feature (565)..(576): n is a, c, g, or t
  misc_feature (583)..(586): n is a, c, g, or t
  misc_feature (588)..(598): n is a, c, g, or t
  misc_feature (609)..(643): n is a, c, g, or t
  unsure (1)..(645): unsure at all n locations
tatgccgttctctttcttctgctatacattcttgcggtaagttaaatggttttaaaacgagaaaattcaagttgcatagcaaataaatcatttctcttatgcagttgtattttgcaggacaccactttcatattttattacctaaagttatggagtgcttatctgcaaatttcttgctatttcaaaggcacgactgcttcttgaggacaggcaaggagctatacttttatgcacaacgatttttttnncttccaaaattcaaacttaaaagattcttctttgcacctcgtcataacaagggccaatagttgatcataatgtaagtttggctattgttgatctcttaaacttgcaaatatgaatgagcttatgttgtattcaactcaatccatatctttaagttaaaagccttagggaacacttacatgactttgttatggttggtgtcacctactaacgatgccaacacgcacgtggctaggcaatgggcccaaattatcctttgattgntttannnnnanttaatttccattaaataggagntcaaatcnnnnnnnnnnnnntnnnnnnnnnnnncacatannnntnnnnnnnnnnngagaaaatcannnnnnnnnnnnnnnnnnnnnnnnnnnnnnnnnnntg

SEQ ID NO: 611 - DNA, 1083 bp, Zea mays
  misc_feature (77)..(78): n is a, c, g, or t
  misc_feature (294)..(297): n is a, c, g, or t
  misc_feature (615)..(620): n is a, c, g, or t
  misc_feature (773)..(773): n is a, c, g, or t
  misc_feature (896)..(897): n is a, c, g, or t
  unsure (1)..(1083): unsure at all n locations
gtgatgtcagattgtttggaataaccagataaacatctatcgggttgactgattcatatcctttcagtgttgctgannactaactgaatgaaagtaggcagacttctgaattaattgcaattttgggaagtgtaacatacaaaaattatcttgtgtccgaggaaatggattgattgattcagaaaaccaaccaccctggttgtgcaaaccaaaaaaagaacaatatagagcagtaaaggttgattataaccagcattccagcaatgaagccaacagtaccattacaaaagcaannnngtcaacatgagacatacctgaaggataaggcacgtatgtcaaatcacttgcagcccactgaatatggaatcattagtgatagaaactgatattcaaattctattgcatagagggtggttacatatatagacccaggggaaccctaaccctaatgggctagcagcccatttacacatacatggataatataggagcatacactctaacaatcagtctggtggagaagctggaaatacacagtacaaaagtagcagaaatagagaaagtacttaaaaatgagaatataaaaggtcaaatagtttagagttgccatacttnnnnnngtgaagaatatgttcctagtcaggaaagcaatttacggttgccaacgctagtgaaaaatatgaaagatatgaatcaagtacagtactatttgacgaccaaatataaccttgatgaatgtctcccaacaaccagccaactaggataaggatttntaatgtcaacccactgaaaactaaagattcattagcattctacaaagcagatgttacaatctaaaatatgttcaatcagcagggaaatggtgataaaacctcaaagctaatttaaaacagttnnctgcctataaactgctggttctcactaacacatacatgtacagttaaatcactccagtcaacccacttattcagaagaatagactgctatggagctgtgagctatatacgagagagatcgccatttatatttgatcaagtatctggctttctctttgaaagggggctaaatgcagctgcaggcatg

SEQ ID NO: 612 - DNA, 569 bp, Zea mays
  misc_feature (315)..(315): n is a, c, g, or t
  misc_feature (327)..(327): n is a, c, g, or t
  misc_feature (464)..(464): n is a, c, g, or t
  unsure (1)..(569): unsure at all n locations
ccttattaggcatcccacatcgtaggtatccagaaattattgtgttccaagaaactgtgtcacaagctccttggggagcagaatcgagaacttgtcttgcagttgttggatagctacaagacgagtacatgttgataagagaattaaggacaaatgtatctgaaaccaagccaagtttgacagaaagggaatgaagctgagcaccaacagaaacagatgggaggcgggcagtggcatagaaagcaatgttgagggagtagctatcgagggtcatacatccagaatggcgtagcagggcgagtaaatcgagggatngagatgggaaangccccaaagagagagatcggaggacagagtggacaagggggagcttgaggagaagacctgaaacaattgactgggagaggaggaggggaatatggcaatgggagagtcgtgggattaaaattgaaagggcatatttntgttcaggaaaagagcttttggcaatgcagaaggcttttgacttcccaacaaatatttgtgaaggtgcacccattaaagccaatggagttgacaagcgatctgtt

SEQ ID NO: 613 - DNA, 802 bp, Zea mays
  misc_feature (630)..(630): n is a, c, g, or t
  misc_feature (682)..(682): n is a, c, g, or t
  unsure (1)..(802): unsure at all n locations
agagaagtataaaatcttttgtcaggcccacgtcttctagtaataactaataacctaagcactggctacttggctagaaccaattagcttcagcaccagtgttttaaaggcaacaaggcaaggtgaggcaagcctcctaggcgaataaggtgatcgtctaggcgacgccatacaaagatctcaatctatgacgccactaaaattatgaagcaggtcataccttaatatgtccaattctgcaataattagtagagtactaatgcgcaacataaaagcttctataggaagtgtacaagcaacatggaagaacaagaaagttttggctttgtaagagatcataggaagagaaaggagcatagacatcttggctcaatccagcctggcaggaagccacagagcagaggacaggaacagagatgcacccaggaagagcaaagcagagcttggccaggccgagcagctttccacttggcctcgccctgggtgtgtacagcacgaaaccaaagctgcgcaccgggatgggctgacggcatgcaatcgacccgcgcaacgctggacataggatgcaggtgaggcaactaccataataatctcgtactccctctcttccttatccttctcgtcttcaanccctctctattccagtattcccatgtgatttctgtgtgatctccttcctgcncacagataaggaacggtggaaggcgaaattttattgcgctggatcgatttcttcacacacgggcactggcatttccttttcccttcatgtggccgtgcaaggctattcacgagtaaggca

SEQ ID NO: 614 - DNA, 1018 bp, Zea mays
  misc_feature (260)..(261): n is a, c, g, or t
  misc_feature (281)..(281): n is a, c, g, or t
  misc_feature (367)..(368): n is a, c, g, or t
  misc_feature (398)..(398): n is a, c, g, or t
  unsure (1)..(1018): unsure at all n locations
tgaacaggcagttacattacaaaacatcgttgacaaagtgccctaactccccagaataataggataggctaccttgggaagcacaattcgtccggaatttgcgacatcactctttgtcaactccttgcgcaaaatgacttggtactctccagagttgaacttctgaaagtcatgtatgtcccaagcacaaggtgacacaggaaggaaaataacttgttaattacgagagaagtgtttgtctatctactgtaccatgaccnngtaactagaactatgtcaanagaattcaaaccagttattttctttttccgatgaacttagcaaatgcagatacgccataagagaagaatatgcacaataaaaaaannggacatggagtgtgtgttagatgtatcacnttattcacggaagcacaactttcatggctctgcttcgactcaggaagagtgccaactgtgtcacgatgaactttgccactgtttctagtgtccatttcatcactgctcctaactattgcaggcaaatcctgtgtatcacacatcagagtagaagtaaagattatgaagggtaatgaaatcagtaaagtttattataaccctgaaggttcatgtctatctatacctctgaattctcgggttctttggcagatatagatccttccatgggcgtcatgtgggaacaaatatttggtccaagggacattgtagtgaaagagtcaaatccaaggctagatgcacaacctgttgtttccatagaatatgaagaaactagctgaggcagaggcagaggcgggattgtgaaagattggttctacatcagaggataacaatcgggacatgctgactattgtgacgcaccagattagttggcccatgcttaaatcaatgtggatacaggttgatgctacattggattctaatatatgtaccatgcaaccacagaaaataatatgatgatacagaaataaactgccaacttacgtaacatgcttgaaggccaaaaggacattaaaacaaca

SEQ ID NO: 615 - DNA, 1180 bp, Zea mays
cgctgccacattgttggatcgcaatcttcttgtgacattggcagtgttttgcacatcttttttttttggtttattgttatgaggagaagtaacacagtgtgagttgtgacacatccatgccaatgccaaattaaaacgacagtgatggcttggagcaggttgcggtaatccactcgctggttgggttgggtgacagacaagcagcttcagtgaagtctactactggatggatgatggatcccattcccatcatcccagctatcaccgaatcacggcacggcgacatgtgctgatgtgcatgggtttaggagatcagtgagatcattgtcattgcgtcggtatacaggtacgccacgccccggcacctcctgctagcatgcagtagcagcagacggcgcatgtgggtgtgggcagtgcccccacgctagctcctctggcacggcgggcgaggcccctcccctcccctcccctctccctccgtccagtccagtcccattcggcattcgccggtctccgatccgcccgccgtgacgccatgcatgcatgtgatcctctgcactgtaaagctcctccggctgtccgcatgcgcgccagccgtgtcagacagctagtgcagcgcagacgcatggcagacggcactccggcgtggttggcctccgtcccgcgatctccggacggactggactggtgctgacggacgctgatggacgccagcccacgcgaagcacagcccctctactacctggctggcctcaagcgtcgtcagtcactgcttgctatgctttgctggatagtagagtggatgctgccgcggccacggtctccgttgctcagctcactggcggcgttcgtcactgtacgtggctgccacgcacgcatcacttcaattccgaaagatcggaggacggacccatggatggatgagctgtttcgttttctttcttcattcaagcgtccatgtcgacggacgaacagaggcaggagacactggacgccccacatgggcagggcaacggaagcctagtgcctgcacagagagaggagccatagatgggctgttgctctgctctctgggcttggtgacaagacacagaacaaaatgaaagacagttgggacgggaagggatagcctgcctgtctgtgtgtctgtctgtcttccccatttaaggacactgtgctg

SEQ ID NO: 616 - DNA, 568 bp, Zea mays
  misc_feature (289)..(289): n is a, c, g, or t
  misc_feature (354)..(354): n is a, c, g, or t
  misc_feature (382)..(383): n is a, c, g, or t
  misc_feature (439)..(439): n is a, c, g, or t
  misc_feature (443)..(444): n is a, c, g, or t
  misc_feature (487)..(487): n is a, c, g, or t
  unsure (1)..(568): unsure at all n locations
attgttgttgtaccaaccattgacaaaaaaaacacaacaaaacagagagacagtgcttacagacggatcagcgaccttcaggtcaagaaactctatctcaatcacaaacctcccagtgacggtgctatcgattgtccacacaaaaccgtcgtatttcagctgtttgtcaaaaattcctgcatacgtgtaaaccacctgttagatagaaattagtcgttcactcccacttgcagacttgctctgtgcctacgggtcattcatatattcagagctataacattttgtttcntaacctaatttttactactaaaattctgcatgtattcttgtagccagatcaaataaactacaggnttcctttcatttttcatgatgtctaacnnacacaccgagaattcaaacatgtccccattttctgtacttgccaaaataatgttcnttgnnattacaagaagacagtagtttttcgtagaagacaatttttttngtcgaacaagttaattagtagaagtaacttacctgggtggactatggtctgctgattaggtggaagagatacaataagttt

SEQ ID NO: 617 - DNA, 678 bp, Zea mays
  misc_feature (532)..(532): n is a, c, g, or t
  misc_feature (574)..(574): n is a, c, g, or t
  misc_feature (577)..(579): n is a, c, g, or t
  misc_feature (586)..(590): n is a, c, g, or t
  misc_feature (593)..(595): n is a, c, g, or t
  misc_feature (597)..(600): n is a, c, g, or t
  misc_feature (605)..(605): n is a, c, g, or t
  misc_feature (617)..(619): n is a, c, g, or t
  misc_feature (621)..(623): n is a, c, g, or t
  misc_feature (629)..(630): n is a, c, g, or t
  misc_feature (643)..(664): n is a, c, g, or t
  misc_feature (666)..(675): n is a, c, g, or t
  unsure (1)..(678): unsure at all n locations
ctacagattctagactagcacattgttaaactaaaacgaagtgtacagataatttaatggcctcacactgatcaaatccccctaatacacatgctatgttcaaacatctcatcataaataataacgatctcaagtctcagtgactaaaacataatttgagtagaatagattgctgaaagccgtcacagaacttgcagataataataaatgataactagacaccgagatacaaaaccgatccaataagatttacggcagacgtctaatccagcatgtagagcatttaaaaagcgccggcagcaacaggatataacccatcaccaccagattcaaatcaaatgaagactccgacccatcgattggacggttggagggtttagcgcacagatctagtctacgtagtagtctattttaactttaaaaccgcaaagagagaagaacgatcgggccgtctgggggagcgtgaaacccactcacatcggaggagttggagatgagctccctgaggaagatctccttgttggagtagaangtgttgatgatgagcgagagcagctggttgatctccgcctgnaannngaacgtnnnnntcnnngnnnncatgncgaaacgacctnnncnnncgcgannagagcgcgagcgnnnnnnnnnnnnnnnnnnnnnntnnnnnnnnnncac

SEQ ID NO: 618 - DNA, 916 bp, Zea mays
  misc_feature (190)..(190): n is a, c, g, or t
  misc_feature (270)..(270): n is a, c, g, or t
  misc_feature (290)..(290): n is a, c, g, or t
  misc_feature (447)..(447): n is a, c, g, or t
  misc_feature (859)..(859): n is a, c, g, or t
  unsure (1)..(916): unsure at all n locations
ctgatgggagaggcaagtttgcttcaacaggtctttgcaagcctatactctctacctcttcaaatgacttgactgtccagctagtacagttttcagccaaggacacttcaactgagatgccttcctcatcaatgtagatgacatgtttcacagtgtcaagttgcccacttatatcaatcagctttttaanttcttttcgtccacatacaacagtagttacctcggtctaaagagcagagtcaagaataagatcagctgaaagtacaacantgcacctataataggtatgncattgtaaattaatcttcaaggaacaatgtttgagaatgaatgccactatatgatgatcataaaagagagagatgccacagctagcaaaagcgaaaaatcaattgtgttgatatatggtatcgtatgggcctgacaatgatataagcaaagatttcnaatacataaacaacacagggtgaagtaacccaacctcatttagtgagtgacatagcgctccctcccccaaagaggcatagattgtgacaactgcaatattttgtctgaagcatgcctagcaaagagagggataaatattaactcaatgtaaaatagcataggtaaaatgtggtgggacaattaatttaacgcaaaataagtaaaacattataactgatgtttacattaaatggtgatataattgaatgaaaccggctttcatgtgacaatacagataacttgttaaagctgcatatccatatcattaccactgcccattcatcaagaaggcgaacatcactgtgtctcttgaatattctacctatatgttttttttgcaaaccttgtattgtgaagaaactcaacgacgagnttacattatctgaacttcagatgtttgatgctcgatagcatctatatttgccaatat

SEQ ID NO: 619 - DNA, 568 bp, Zea mays
  misc_feature (8)..(8): n is a, c, g, or t
  misc_feature (193)..(193): n is a, c, g, or t
  unsure (1)..(568): unsure at all n locations
gatattgnccagaaatggtgggtgttctccaatgacgggcagcaaacgtgcatgcaagtgttaagccttcaagggctcttcttgttatccatatgggtgatatcgtccatatcctccagtgaagcttcccctattcatgtcaggtgtgctagcagatccataaccacctagcgtaggatcatatgccccaccntaggcggtgccactaaagccagaactactagggccaccaaagctctcttcagcatcaccaccaaacccaggattaccaccaggggcgccgaagctctcatcacctccaccacgtctatagccacttaagtcagcaccagcataagatccaccaaaacctcctccatataacccaaagcgaccaggataaccaaacgaagacgcggctccatatccccctcctaatcctgcatagtaacgaccatatgcaccaccaaaatcacctaccccaccatagctgctgagcctagcaccaaatcctgtatcgctcctataaggaccaaatccaccacccctgtagtttccataagcactggccattccaccatagttgtca

SEQ ID NO: 620 - DNA, 648 bp, Zea mays
  misc_feature (54)..(54): n is a, c, g, or t
  misc_feature (58)..(58): n is a, c, g, or t
  misc_feature (181)..(181): n is a, c, g, or t
  misc_feature (247)..(261): n is a, c, g, or t
  misc_feature (313)..(313): n is a, c, g, or t
  misc_feature (383)..(383): n is a, c, g, or t
  misc_feature (645)..(645): n is a, c, g, or t
  unsure (1)..(648): unsure at all n locations
acgctaattagacacctgaaaaaaaacaactcgtgtgatggttatgttttcttncaanggacttacctcaggttccaaccacaaaagaaagggaaagcctacatttttcgtggtgacagttccatatcatggatttcatatcgttgcaaacttttgcttctgctacgggccagctaccagncaaccaacaacagtgaagaaaaaacctccctagagtccttgactccttgtcatcctcaaatttaannnnnnnnnnnnnnngtggattcctattcctatcatccggataatagctactctacatatgattttncccctttttgattgtacaggctgacatacggactggactacaaagggaacatatgtggcagcaggcatgncgatcctgatttgtatcagttagatgttcgctattgggtgaaccccaaccaggtctaccaaagtggcctcaaaaccagtcacatcgagctacctgatgctaaaaccatctgcctgatggaatgcccacttcctgccgaagatggcttgaattttgtttgcgattatccagaaggtgacatacgcctctctgtcgacgactggattgacagggactacgattacttcgagtacctcacaccagacatgaggaatagttctctncag

SEQ ID NO: 621 - DNA, 561 bp, Zea mays
  misc_feature (1)..(1): n is a, c, g, or t
  misc_feature (528)..(532): n is a, c, g, or t
  misc_feature (539)..(540): n is a, c, g, or t
  misc_feature (542)..(546): n is a, c, g, or t
  misc_feature (551)..(555): n is a, c, g, or t
  misc_feature (557)..(558): n is a, c, g, or t
  unsure (1)..(561): unsure at all n locations
nttagttgagctcctgctcttagcacttgggaagatgcttcagggtttcctctagtctcattggatgctgcctgttgctgggatgacaggttggtgcaccaagccaagaggcatgttcatgttgctagcgttctccgccgctgcactgccgtcacagtttggctccaataagcgcacaagcgatagaaagatctccattctggttacgtcccggttcgcctgcatggaacagcatcatctcattcctttggatttccattctggttactgtttattacttcagattttgaacttctagttactgttttttacttcagattttgatctgaaagaatcctgattattaaatttagctgcattacctcaacagtgaaccgtgcccagattttacttttgcgcatttccatcacacccctcaagatagtcagtcctagtcctttgatgaaatcagctatctccaagaagattcctctatcctcgcaaagcatctgtagaggcaaccaagtcatcacaatcacatgcgttctnnnnnaaacatnntnnnnnaaacnnnnngnngta

SEQ ID NO: 622 - DNA, 562 bp, Zea mays
  misc_feature (97)..(97): n is a, c, g, or t
  misc_feature (150)..(150): n is a, c, g, or t
  misc_feature (203)..(204): n is a, c, g, or t
  misc_feature (207)..(207): n is a, c, g, or t
  misc_feature (209)..(211): n is a, c, g, or t
  misc_feature (222)..(223): n is a, c, g, or t
  misc_feature (272)..(273): n is a, c, g, or t
  misc_feature (311)..(312): n is a, c, g, or t
  misc_feature (345)..(345): n is a, c, g, or t
  misc_feature (424)..(431): n is a, c, g, or t
  misc_feature (459)..(459): n is a, c, g, or t
  misc_feature (478)..(478): n is a, c, g, or t
  misc_feature (496)..(496): n is a, c, g, or t
  misc_feature (514)..(516): n is a, c, g, or t
  unsure (1)..(562): unsure at all n locations
cgtaacagtcccgatcaccctgacagccgccaactcgctgattcaggaagtaggagctgtggttctctcttgagaaccacgcaaccacgttcgctangaggaagagagccgcatagaggtatctgacgttcatagggctgaggccctggnagaagaagccacagttcatcgtcatccgtgctttgcttggctgcctgcctgcnngcngnnnatatatatatnnttcattattcacagtattgctatattttagagaaataggattggcatanncataaatataatcaaattagctactgcatgctagacanngtggcggagccggccggcataaaactgtcaccnccgctgcgctgcacctgcatgccgtccgccggagcaggcgattggggcatccccgcagctacatactgctagctagatnnnnnnnnacatatggtgctcacctgcagagatgcnctgaacgtggagaagaccnctccaacacaacgggcgnggcgatcaaccaacagtnnngcagtgtgagcgcgttggacgagagcgagaggcgagagatcaagca

SEQ ID NO: 623 - DNA, 729 bp, Zea mays
  misc_feature (47)..(47): n is a, c, g, or t
  misc_feature (337)..(337): n is a, c, g, or t
  misc_feature (500)..(500): n is a, c, g, or t
  misc_feature (544)..(546): n is a, c, g, or t
  misc_feature (553)..(559): n is a, c, g, or t
  misc_feature (579)..(585): n is a, c, g, or t
  misc_feature (609)..(610): n is a, c, g, or t
  misc_feature (614)..(614): n is a, c, g, or t
  misc_feature (618)..(623): n is a, c, g, or t
  misc_feature (630)..(642): n is a, c, g, or t
  misc_feature (648)..(689): n is a, c, g, or t
  misc_feature (692)..(708): n is a, c, g, or t
  misc_feature (713)..(721): n is a, c, g, or t
  misc_feature (727)..(728): n is a, c, g, or t
  unsure (1)..(729): unsure at all n locations
cggaatttgcagcaaatttatctttctgtacccctgttacagctgangtcacagcagaaccaaactggccacccattgaactgcctgataactctccagatttcgaggacactggagactgaatcacaggcccagtaggggcacgagagctaggtgctaactttcttctctgaattatgtcttcttttttgaagtccttctcagctgcgaaccgagtattttgccactgtcccatgtttggaacattatttcttgccactgattgttgtggtaaatgttgagattgggattgctgctgatccagcatggaagtttcaggtgccatagactgcaaggngtcttttgacttatcagaaccatccatctgctcctgcttagcatcgtatctcaaattttgctgatgactaaaatataaggaagatcctggatcttgcatgttgttcatcatcgaagaaggatatctctgaccactcagtgaagatgcatactgcatccccttnacatctaattgtggatgcagttgatggttcttccattgcatctnnngcccacnnnnnnnttgaggccttatctgctgcnnnnnnncatcatcaataccaccagttcgcnntatnctcnnnnnntcttgannnnnnnnnnnnngcattnnnnnnnnnnnnnnnnnnnnnnnnnnnnnnnnnnnnnnnnnnctnnnnnnnnnnnnnnnnngatgnnnnnnnnngcatgnnc

SEQ ID NO: 624 - DNA, 684 bp, Zea mays
  misc_feature (147)..(147): n is a, c, g, or t
  misc_feature (298)..(298): n is a, c, g, or t
  misc_feature (536)..(536): n is a, c, g, or t
  misc_feature (599)..(601): n is a, c, g, or t
  misc_feature (609)..(609): n is a, c, g, or t
  misc_feature (622)..(626): n is a, c, g, or t
  misc_feature (637)..(637): n is a, c, g, or t
  misc_feature (639)..(639): n is a, c, g, or t
  misc_feature (641)..(641): n is a, c, g, or t
  misc_feature (649)..(659): n is a, c, g, or t
  misc_feature (661)..(669): n is a, c, g, or t
  misc_feature (673)..(679): n is a, c, g, or t
  unsure (1)..(684): unsure at all n locations
tcgaagctgggaggctacctggcgatatttttgatgagataccaagcaagtactataatggatcagttgtttgtgaggtaagttgttttatcacacataagaaaggctatgcatgcaatgctattgaactgcaacatgctgaaaccnttctgaaatttattctcttataaattgtggttggtttctctgatacatggttcaaaaagcatgctggtacaatttctgtactgaggatttatgctatatgggagaaatccttctttaaaagaaaaactagaagtttggtgagctttactgncgacatgttctataatatgccaacctaccagtactgtaccaacctttttctaacacttatttcagaaacaaccgttatgcattatcatgaagcatcatgttgtgtcatgtgctcatggtcatgtgctactgtaccttattgataagagaccattgagtctttagcagtacttcattgtcttacatcgacataagtaatgagttctctttctagatacatgactaccgaaagcatgtgnccaaccaagcgcctgcatcatctgctgagctaggatcaccaattgtgaataaagtacgactgnnnatgacctntgaaaatgttgtnnnnnacattaccctncnanctgatgannnnnnnnnnnannnnnnnnntatnnnnnnnatgct

SEQ ID NO: 625 - DNA, 713 bp, Zea mays
  misc_feature (271)..(271): n is a, c, g, or t
  misc_feature (355)..(355): n is a, c, g, or t
  misc_feature (430)..(430): n is a, c, g, or t
  misc_feature (535)..(535): n is a, c, g, or t
  misc_feature (542)..(542): n is a, c, g, or t
  misc_feature (623)..(623): n is a, c, g, or t
  misc_feature (677)..(677): n is a, c, g, or t
  misc_feature (710)..(712): n is a, c, g, or t
  unsure (1)..(713): unsure at all n locations
atggtgactccccacataaaatccaaggcagaagccaccaaagccctcgggtaacctttcttgcttagagattgctctgaataagtccacctcaatcttttttagtgattccactgtctgtagaaagcttctttcttgtacaaggaatcgttcctggaatattccctcctatgttattcccctgttagtttgccaaccaatcacagctcttaaaagggtgattactgattgtccatgcttttctcatgctgagtaaactaagcagtaacanaaaacagattgtgcagtgtcagtagctattatatatggtgacacctctgtattttattatagcttgtatgtttaccttatcttnattgattgttaactatgtaacaaagacagtttcgttgtttgaaccttgcaggtttcggggtttcagtattctccnagcccacagaggtttagtgagtgccacatatcatcttccactgatatagcattcagtttttgtattttcagtaatgcagtagtaatgtacttatggcagtatgcnctttgcngctgaaattttagacggttcaacttcagagatagctaacaatgggtctgagtcaacaatggatgcgaagcgtagggccagncctgtaccagcacatcataactccaggcagatgaacaacaatcatcattctacnactactactactaccaccaccacgtcatctgcnnna

SEQ ID NO: 626 - DNA, 608 bp, Zea mays
  misc_feature (115)..(124): n is a, c, g, or t
  misc_feature (210)..(210): n is a, c, g, or t
  misc_feature (231)..(231): n is a, c, g, or t
  misc_feature (350)..(351): n is a, c, g, or t
  misc_feature (358)..(360): n is a, c, g, or t
  misc_feature (562)..(563): n is a, c, g, or t
  unsure (1)..(608): unsure at all n locations
ttatgctagttagattttgcaaagaaaagttcaattaccccagttatcttgtttccctgaatccttggtacacttgtagtttcttcttaattatgtaactttaggttatataatnnnnnnnnnngctacatcttgattgctgctgttcctataataatattccatgatttggcatttttggcttcatttagctgaaccaactgtaatctnacttcttatcacccccgggcnttaatgatgcttctgtagccaagggtgggctgagggaggcttttgcagctccagggttaggttacgttgatattccaaatgcacagataagaaaggtaaattttgatggccagaaacannttttttnnncatattagatgttagtaacttgagcatgtgttgatttctgttgtcttcaggttaccgcaaaccgcttgctagcatctaaacagaccattcctcattactacttgacagtagatgcacgtgttgacaaacttgtcaagtatgtttctaacctaatatatgatttacagagctcttttcgttggtgggacagcacttctaactnngagttatgtcattctaatccacaggttgcgaggtgaactgaatcc

SEQ ID NO: 627 - DNA, 1233 bp, Zea mays
  misc_feature (1)..(16): n is a, c, g, or t
  misc_feature (588)..(591): n is a, c, g, or t
  misc_feature (599)..(601): n is a, c, g, or t
  misc_feature (618)..(618): n is a, c, g, or t
  misc_feature (621)..(622): n is a, c, g, or t
  misc_feature (657)..(659): n is a, c, g, or t
  misc_feature (661)..(661): n is a, c, g, or t
  misc_feature (670)..(670): n is a, c, g, or t
  misc_feature (677)..(678): n is a, c, g, or t
  misc_feature (680)..(681): n is a, c, g, or t
  misc_feature (684)..(685): n is a, c, g, or t
  misc_feature (770)..(771): n is a, c, g, or t
  misc_feature (779)..(779): n is a, c, g, or t
  misc_feature (844)..(844): n is a, c, g, or t
  misc_feature (1012)..(1012): n is a, c, g, or t
  misc_feature (1091)..(1091): n is a, c, g, or t
  misc_feature (1140)..(1140): n is a, c, g, or t
  unsure (1)..(1233): unsure at all n locations
nnnnnnnnnnnnnnnnagtctatgataaagcttgtgcaaaccttgttagtgttaagaaaaaggttaaacttttttcctgaatatttttgtatctccaatgattttctgatgattgccaaatggctattgtattcaaatagtgtacatctttatgttgtggataatctccactgaatagctaaaactttatactctaaactttggcatccatgctatcatcatatcacacagattcaggtactttctatcgagtgttctgaagaggctaggaaggtggagcacgcgctagagtgggaggaagctttgaagcagacggtgtctgatgagaaggcgaaacagctcgaggtcatcagtgaagtcgagcaagcaggaaaatcattcacccgagaggcttattcaaggtacaagacagaaatggctgccagcatgatctgtcaggataaggtgcagattgttgatgcgattttgacaaagagcagaagttgcaggcggtattcgaagagagatatagagcttgccactgacaacttctctgaagaaaggaagatcggtgagggtggttatggcaatgtgtacaggtgcaccctnnnncacactgnnntagctgtgaaggtcatncannaaaactccattgacaaaactgatgagttcctgaannngntaactgatngttcctnnanncgnngacaccattcaatattcacactacattcaatattcacactactggagtcttttgatacgaagtcaaagttgtctgaaccaaaaannaaatttcncgcaggttgagattcttagccagcttcgccatcccaacctggttttgttgcttggtttctgtccngaaattggctgcctggtgtacgaatacctgaagaacgggagcctagaagaccagctcttcaacagcgaagggtgccaaccactgcactggttcctccggttccaggtcgtcttcgaggtgtcctgcggactcgcattcctgcacgcgagaagcccagagcctgtcgtncaccgcgacctgaaaccggccaacatcttgctggacaggaactacgtgggcaaggtcggcgacgtcggtttcgcgaagntcgtctctgatctcgtgcccgactggcagaccgagtacaaggacacgancgtcgccggcacgctgtactacacggaccccgagtaccagcagaccggcaccgtgcgtcccaagtccgacgtgttcgcgctgggagtcgtcat

SEQ ID NO: 628 - DNA, 520 bp, Zea mays
  misc_feature (489)..(490): n is a, c, g, or t
  misc_feature (493)..(503): n is a, c, g, or t
  misc_feature (505)..(506): n is a, c, g, or t
  misc_feature (515)..(519): n is a, c, g, or t
  unsure (1)..(520): unsure at all n locations
cagagtaataaaacacagtgaagaaaaaggagtaactgttacgcaactcgtcaggaaaaaaatgccaataaactacaatcgaaatgttggtgagaactgagaaaatatgacgcggccaaacgaattattgcatacatgcagaaacgctagtgttggatagttccagaaggaattaattatacatgttattgtgctccgagatcaaaataatgtaatgattctctatgcgtcaaaccttataacatccaaattccaccaatggtaattaagctgaagccgtgctacatgttcagcatgagcgtaaactaagctcagattactagtcttaagataatctaaggacaacgacgatcatcccaaacaacttaagtaacagttatacagcgacaacaccagtacagggggcgcctcaaggaccaaaaccgttctcttctctacagtagtgacgtaacactggacggatcaagagacaatggccaaaggtagtannacnnnnnnnnnnntnnaaacctacnnnnna

SEQ ID NO: 629 - DNA, 1294 bp, Zea mays
  misc_feature (152)..(152): n is a, c, g, or t
  misc_feature (203)..(203): n is a, c, g, or t
  misc_feature (317)..(317): n is a, c, g, or t
  misc_feature (345)..(345): n is a, c, g, or t
  misc_feature (402)..(402): n is a, c, g, or t
  misc_feature (406)..(406): n is a, c, g, or t
  misc_feature (418)..(418): n is a, c, g, or t
  misc_feature (471)..(471): n is a, c, g, or t
  misc_feature (473)..(473): n is a, c, g, or t
  misc_feature (483)..(483): n is a, c, g, or t
  misc_feature (493)..(493): n is a, c, g, or t
  misc_feature (525)..(525): n is a, c, g, or t
  misc_feature (536)..(536): n is a, c, g, or t
  misc_feature (553)..(553): n is a, c, g, or t
  misc_feature (558)..(559): n is a, c, g, or t
  misc_feature (574)..(574): n is a, c, g, or t
  misc_feature (576)..(580): n is a, c, g, or t
  misc_feature (586)..(586): n is a, c, g, or t
  misc_feature (589)..(589): n is a, c, g, or t
  misc_feature (620)..(622): n is a, c, g, or t
  misc_feature (625)..(627): n is a, c, g, or t
  misc_feature (634)..(644): n is a, c, g, or t
  misc_feature (647)..(650): n is a, c, g, or t
  misc_feature (652)..(681): n is a, c, g, or t
  misc_feature (687)..(702): n is a, c, g, or t
  misc_feature (704)..(720): n is a, c, g, or t
  misc_feature (722)..(723): n is a, c, g, or t
  misc_feature (725)..(725): n is a, c, g, or t
  misc_feature (729)..(730): n is a, c, g, or t
  misc_feature (734)..(745): n is a, c, g, or t
  misc_feature (747)..(755): n is a, c, g, or t
  misc_feature (757)..(765): n is a, c, g, or t
  misc_feature (770)..(771): n is a, c, g, or t
  misc_feature (779)..(782): n is a, c, g, or t
  misc_feature (784)..(791): n is a, c, g, or t
  misc_feature (798)..(799): n is a, c, g, or t
  misc_feature (801)..(801): n is a, c, g, or t
  misc_feature (805)..(812): n is a, c, g, or t
  misc_feature (816)..(824): n is a, c, g, or t
  misc_feature (831)..(836): n is a, c, g, or t
  misc_feature (838)..(838): n is a, c, g, or t
  unsure (1)..(1294): unsure at all n locations
ttgttgacagcggagcgcaatcgactatcatatcaaaaagttgcgctgaacgttgcgggtatgattataatttagttgatttgagctgcttagattttatatttgcagcaccatggtttttgtgattttcagcatggagaacataatattangtagcaatcagccaatcatagggggtgtttgctatagctctgcttcactantgaagtagctttgctggaggagctgttctggaatagatctgctggtgcatttgaagctgtttttctagaccatttggtaaaacagcttctcatgatagataaataaggcaaaanggcctctatccgagttggttaggtggtntgggtagcactccttaggtcctgagttcgaatcccagtggaagcgaattttaggctnaggnttaaaaaatgtnactcgttggttcccctggtcgtgtgcacacaagatggactgacctatgggggncngatcctcgtntaggggctgngagggcttaaatcacgagtaaagatctggtcnataggggatgnaccctcatgttgcacgngggannaactttcgtgacctntnnnnntcaggnctncgattgagcttcttcttaatataataccgtnnnagnnntcttttnnnnnnnnnnngannnntnnnnnnnnnnnnnnnnnnnnnnnnnnnnnnactacnnnnnnnnnnnnnnnntnnnnnnnnnnnnnnnnncnncntctnnatcnnnnnnnnnnnntnnnnnnnnncnnnnnnnnncgctnnattccgannnngnnnnnnnntgtgtcnngncatnnnnnnnnaccnnnnnnnnntacgccnnnnnncnctgcgctaggagctccagcgaccccacgccagcacaacttcttcacgttgccacgcctcccctcgctgtcaccgcgcgcgcccctggggcaaattcgactatgctcacatgaggccccacggagacaagtgagagcagggtgaaggtgcctttttcagctccacctcacacctttgacttgtgtgagcagaaaaaaacgggacttcacatgtggagctgcaacctccctaaccgtttggctgttgttcttgtgagactgcttcgggagttgtcccaggagcggtaacaaacggcctcttagtttataaagtacttcctccggcccaaaataaatcaattcctagaatcacccttagccaaactattaagtttgaccaacttcataggaatgggtatgtgcaccaaataagtacattacgaggctgttgctttgaattaaagctagttgttcggact

SEQ ID NO: 630 - DNA, 375 bp, Zea mays
  misc_feature (75)..(75): n is a, c, g, or t
  misc_feature (79)..(81): n is a, c, g, or t
  misc_feature (88)..(88): n is a, c, g, or t
  misc_feature (119)..(119): n is a, c, g, or t
  misc_feature (130)..(130): n is a, c, g, or t
  misc_feature (343)..(343): n is a, c, g, or t
  unsure (1)..(375): unsure at all n locations
tgttgtttccaagcagtttgaatcctgacattcttgaaggcctacttggatctggtcagtccgttaggaaattgnatannntttgttntgtttccatacctgagtactctgttgacttntgtgcctttgngcagtgggtggtgtcatggctttcctcactttgcatgaaatgctgcctcttgcatttgactattgtggccagaagcaagctgtcaaagctgtctttgtgggcatggcctgcatgtctgcaaggtttgtcgattcttcaaattaagcaaagggattccttgagtaaacattttgtcttaatgaccagtatggatttgctttccctttccgcaanagactcgtatgtggctttttataacttttgca

SEQ ID NO: 631 - DNA, 1115 bp, Zea mays
  misc_feature (758)..(758): n is a, c, g, or t
  misc_feature (1101)..(1101): n is a, c, g, or t
  misc_feature (1108)..(1109): n is a, c, g, or t
  unsure (1)..(1115): unsure at all n locations
ggcttcttttgctaaagagggcctatgattaacagttggaaacgaccataacaaaatagacacaagttctggcctggcacacagagatacctatgcaaatcatcagcatcaacacttctctggttgaacctaaatagaggattagatcataggagaacattcaagaacaaacgcagaaaacagatttagttggccaacagcgaaggactaaagaagtcagcaaatttagtagtaggcctgaagccagcaattcattagcgtagacctaaagaagccaacaaatccatcatcagaggccaagttttgagttacattgactaatgactatgaggtaagaaacagggcatggatctcaagcagcggcaggcttgcgcagctcactctcaccatgggcaaagtggcatttgccgccataagagcatgacccttttgcgaagttctcacacatcttggtcttgaagttgcttcctatgccactgatgctaacaatcagctcgatgaccatagcactagcgttcctgatctgatcaaaggtgccctcaaactcaatgtttttcaagctggtgtctgattcatggcggtcctcctgaatgaccaccttggcccctgtgacggaagatatttgctttatgttagctccacccttcccaatgatgccacctgcaagggacgcatcgacactgatcttggccgtggcataagcgccgaagctagctggagtggccaaaccagggttggccataggtggaggcgccatnggtggaggcgccatgggtggaggcgccataggtagaggtgccataggtggaggcgccataggtggaggtgccatgggtggaggcgccataggtggaggcgccataggtagaggtgccataggtggaggcgccataggtggaggtgccatgggtagaggtgccataggtggaggcgccataggtagaggtgccatagttggaggtgccatgggtggaggcgccataggtggaggtgccataggtggaggtgcaaaataaccggttggtggtggtccgatggggggtggcatatagttgtccatcatagacttgccaagctccctttcaccatgtgcaaagtggnatctgtnnccccat

SEQ ID NO: 632 - DNA, 688 bp, Zea mays
  misc_feature (144)..(144): n is a, c, g, or t
  misc_feature (241)..(241): n is a, c, g, or t
  misc_feature (321)..(321): n is a, c, g, or t
  misc_feature (329)..(329): n is a, c, g, or t
  misc_feature (342)..(342): n is a, c, g, or t
  misc_feature (392)..(443): n is a, c, g, or t
  misc_feature (495)..(495): n is a, c, g, or t
  misc_feature (561)..(562): n is a, c, g, or t
  misc_feature (568)..(568): n is a, c, g, or t
  misc_feature (573)..(574): n is a, c, g, or t
  misc_feature (607)..(612): n is a, c, g, or t
  misc_feature (617)..(618): n is a, c, g, or t
  misc_feature (628)..(632): n is a, c, g, or t
  misc_feature (638)..(638): n is a, c, g, or t
  misc_feature (644)..(644): n is a, c, g, or t
  misc_feature (646)..(650): n is a, c, g, or t
  misc_feature (673)..(676): n is a, c, g, or t
  misc_feature (679)..(679): n is a, c, g, or t
  misc_feature (686)..(687): n is a, c, g, or t
  unsure (1)..(688): unsure at all n locations
ataaattgacccgctgttggagtgacataattgcaaggagaattgtcgcgtgtattcgtccacttccactatacttgtgcgatacaggtccttgagcttagccaagctattggttcagagagaaggcttgaaccacatgttgangaaatccgcaaagcaagcctaggagaggataccgtggttgcgctcgatggattaataccactcagttgttgcgccctccatctgaagagccgcaagncaaacgttctcagcgagcgtacacatacatgaaagtaggttttgcacgtggtcaaccaagggagcgggttagactcgccntgagagcntggagaacgttancttgtggtgatgaaggtcaaagtcatcgcggaagccctagatgaagaagnnnnnnnnnnnnnnnnnnnnnnnnnnnnnnnnnnnnnnnnnnnnnnnnnnnncggaacatggttgctgcctttgctgccctagtggaggggacaggcggaggcntcttggatatatatcatccatgggtcgcttcaccagtcgtgccaccatacaatcatgggagaccanncgattntcganngttgtaagctatggcaggatctggtccaatttnnnnnngtcgnngtcaccgtcnnnnngatcantgacantnnnnnacatagttgtcgatgcatcgatnnnntcntatactnnt

SEQ ID NO: 633 - DNA, 662 bp, Zea mays
gaggggaaagaggctggagccggctcaaatggactgcggaagcgattccgacggcgctcccgaggagctcaccgccgtccaggtacgtctagtcctctcccctccaggacccgaccctacgggaggtagattcaggattaggtacggttcgcctgtgtattccgcacaagcagacggtaggtggggtggacgcgcagatagccccgtaagaggattctacagctctgtgccgtcgatttggttgaccgagaactattttattttttggttggattagagctgttggcctttttagccttgccggtcatattgtttcttcttcacgcttcaagctctatgttgagatatgcaaaaggtactgagccttgttatcgtcttttagggtgttgagaagcacgaagagatcagtcaagttgagaaggatagtgccatcaggtgtgtttcttatgcatactttacagctgagctgactggatggacctgggccctctgctgcccaatgtgctacgttgaactgttcttgtttctgtagaatgcacgtgagtagtagttgccaattgatgcttgctatggagactagttttgtcttgtggactatgctagatttctcttgctcggtgctgtgtctacacttattcattctcttggtttcagtagatgca

SEQ ID NO: 634 - DNA, 675 bp, Zea mays
  misc_feature (243)..(243): n is a, c, g, or t
  misc_feature (513)..(513): n is a, c, g, or t
  misc_feature (654)..(657): n is a, c, g, or t
  unsure (1)..(675): unsure at all n locations
ccaagccacgacggcagggcgtcgcagtccggcgtgccgcggtggccgcggacggtgttcctggtgggcgccatgtcgtgcctggccatcagcgcgacggcccacctgctggcgtgccactcgcggcgcgccagcgtggtgttctggcagctcgactacgcgggcatctccgtgatgatcgtcgcctccttcgtgccgccggtgtactacgccttcctctgccacccgccggcgcgggcggcntacctgtccgccatcgcggcgctgggcgcgctcgtggtggccgcgctgctctccccgtcctgctcgtccccgcgctaccgccgcctccgcgcggcgctgttcctggccatgggcctgtcgggcgtcgtcccggcgctgcacgcgctgtggctcaactggggccacgccgcctgctacctggcgctcggcctcgaggtcgccatgggtctcgcctacgccacgggcgcatggttctacgtcagccgcgtgccggagaagtggaggcccggngtgttcgacgtcgtgggccacagccaccagatcttccacgtgctcgtgctcgtcggcgccgtcacgcactacgtcgccgtcgccgtgctcatccactggcgggagaaggtggctgccgcctgtggcgcggcgtcgtaggcnnnnggggcttgctgctcctgg

SEQ ID NO: 635 - DNA, 522 bp, Zea mays
  misc_feature (116)..(116): n is a, c, g, or t
  misc_feature (122)..(122): n is a, c, g, or t
  misc_feature (208)..(208): n is a, c, g, or t
  misc_feature (225)..(225): n is a, c, g, or t
  misc_feature (376)..(376): n is a, c, g, or t
  misc_feature (488)..(492): n is a, c, g, or t
  misc_feature (497)..(513): n is a, c, g, or t
  misc_feature (517)..(517): n is a, c, g, or t
  misc_feature (520)..(520): n is a, c, g, or t
  unsure (1)..(522): unsure at all n locations
ctccgggtgaaggcactggaggaaccatgtctgacgatgaagataaccaggtggatagtgaagccaacatgttcgatggaaatgatggatcagacggtatgggctttggccccctnatactnacagagggtgaacggtccttagttgagcgtgtacggaaggagctgaagaacgagcttaagcaggtaactctctttgaaaatgcttnattcatcatcgtttatngtgcattgttgactaacaaaacgtttcctacctctagggttacaaggaaaagcttgtcgatatcagggaagagatcatgcgcaaacgcagggctgggaaacttcctggagataccgcatctgtactgaaagcttggtggcaagctcattcnaagtggccgtacccaactgtacgtgacaccgcgtcaacttaattccctcgttagcttctgctatcaggttcggctcattgatgagcaactctttgcttactcgtccaggaannnnncaagnnnnnnnnnnnnnnnnnaacnggntt

SEQ ID NO: 636 - DNA, 514 bp, Zea mays
ggagtggaggaccttgccactgccttcgctcagccatggaggagctctcacgtgtgggtgtagagggcgttgtggtggctgtggtttgtgtagggttatgggagaagggaggcagcaggcctgggaagtctgagagttatccaacaagctgttggtgggctgagctgtatcggattgacgtatcaaacaggcccaacataccagtaaagagtatctggattattgttggtttatttttttacagatgcttcacagatatgtatccattgcgtatccatgctgtatccatatgggatatatattcaatacaggataaaataagctgatgcaagccatgagttggtgacttggtgtgttgcttggataacaaattatgttttatggttactcagtttagagatgaatctgtgctatttgatgtgctaggtataaccactgaacctcgtttgccttcaagttcaataaaaacagggttgtcggagatattttgtagtttggtccagaaatgcaatgt

SEQ ID NO: 637 - DNA, 612 bp, Zea mays
  misc_feature (162)..(162): n is a, c, g, or t
  misc_feature (284)..(284): n is a, c, g, or t
  misc_feature (287)..(287): n is a, c, g, or t
  misc_feature (339)..(460): n is a, c, g, or t
  misc_feature (463)..(463): n is a, c, g, or t
  unsure (1)..(612): unsure at all n locations
ttttttcataatagagaacttattgaggaataagtgtggaaaattttgccaaacaacatgttagatgaattatcattgtgcatgtcaaagatgagaagtaacgaatgtgcctaacttaccaagacgatcaagagctgatggtggcattataactggaaagangcaaaataataatcctgtaaacttccaatggcaactaaaatagatacggagctcagaactcagggaacagagaacatacttttgtcaccggcctcaagttgtggctgcaaaaaggtaaaganatnttttacagtaaattccaaaattgtgaaatgtaatattatcttaaaagctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnganatttcatggagaattttttgatgttgtagatgttgatccattttttctacatactttacagctagagaattttgatttaggaaaaaggctatactgactattattttggaacagggctgtagtgattattctagcattagatgtacaga

SEQ ID NO: 638 - DNA, 1078 bp, Zea mays
  misc_feature (371)..(372): n is a, c, g, or t
  misc_feature (392)..(392): n is a, c, g, or t
  unsure (1)..(1078): unsure at all n locations
caggttgtactggccagctggtgcaatgtaacttattttccccatagaacccggtggaagagcaacatggtgctgcatcaatgtgttctcaaaaacagtctgcaacacacacccagtccgcaatcattaggatgtaaacacgggttaacagcatgcatttacatatcacagacagctagtcttcagaatgaagccatagatggaagtcaatgtcataagaacttacagcgtatagatctccacctgtgatgacatctccaacacctggaaatatagcacaagaaaacctatttagatagcatcaaagttcaaatacaacttagagataacaaaaacagcatgcaaaaccatttcaacaatggaggtactannttaagtcactacctagcttngttggctgaaattcccacaatacatctttgtcaagggcaggaactgaaacaccacgaggaatatacacatctcctgacttaatagcgatggtttttagaggtcgctgcaaacataatagagggcgagtgaggataatagacaaaaaataatgtaaatggccgcaaaagtaagccctgtcgtgttcagcacacctggataccgtcaaaaatgtttccaagaattccaggtcccaattcaactgaaagaggctgcatgggaatagccattacatgttaaatgatagcaaaagaatgatattaaaagatatagtaagatctgaagacaactaaaacaaacctttcttgttctcaatacagggtcattaaccatcagtccagctgtttcctcataaactgcaacacgcaaatgacggcactcgcgaggttagtaccgtgtattcaactggaaaggagcttttcatgcccatgggtgaataatttattatagatgatctgccatgttgcataccttggattgtagctgaatcgccctcaagacggataatttccccaatgaggttatcatgtccgacacgaacaagttcatacatggcagcaccacccattccatcagccacaaccacaggtccagagacctgcaataacccagcatcaaggctaatcaaagtggggcttgttatatacat

SEQ ID NO: 639 - DNA, 661 bp, Zea mays
  misc_feature (209)..(209): n is a, c, g, or t
  unsure (1)..(661): unsure at all n locations
tacccctgacagcaaagaacaatgcatgctattaaatctgttagatggttcagaaatttctgagaaacacaaaataggttctgcatagaactgaacgtgaagacagggacaaaccgcagtgagaacccggtccttctgtacaagattaagaatgaacccagcctccttactgttatttgcttcagtagaatcatctctgcctaccatantagttgtaagcatagactttccatagatcacagtttcaagaatcaagtgtgacatgacatggaaacgtgcaccatcatcaagttgcccatactgggatcttacccttagtaaggacctgcagcaataagttactaaactgtcaaattaaccatcatcaagcgaatgattatatataaaataagattacaaatcctaccaaatcaagaaatgcagtctatttttgcactgatcatcttcagagataatattagggagcagtgatataaattgctgaacacatttggatgcgttttctaagccagctttgcagagatacataatgatgagatggaagataattcttggaaatctctcccctcttagcatcatagctttgtcagcaactttgttagtctttccacctaatgcgctactgatgcctcctgttacaactacagcagccatttctgca

SEQ ID NO: 640 - DNA, 418 bp, Zea mays
  misc_feature (26)..(26): n is a, c, g, or t
  misc_feature (353)..(358): n is a, c, g, or t
  misc_feature (378)..(383): n is a, c, g, or t
  unsure (1)..(418): unsure at all n locations
aacgaaatactagttgacatggcagngtgtgctgccaccaagctccagtgccttagggtatgttccttaccatggctaccatgtgtagatagatagcatttacaaatcgatggaatgcatggagctccttagactagtgaaaaaaagaaagccagagctgaaaggactgtaaaaaatgttcctgtaatcgacatttcaagctccgctgtttattgttgtacttgtaatattcatttgtgccttttgggatctctcagcatttgtcacggtacttcaaacaatctgctacgacaatggagcaacagttccaaaaggagactaggttctacagctccttaataaggtagttactnnnnnngaagttctaaatgtgaaagnnnnnnaaaaaactgaagttcttgacccaattgctgatgca

SEQ ID NO: 641 - DNA, 354 bp, Zea mays
atcattgggtgtggtggttatggtctagtctacaaggctgaactacctgatggctgcaagcttgctatcaagaagctcaatgatgaaatgtgcttgatggaaagggagttcactgcagaggttgaagcactgtccatggcacagcacgaccatcttgtgccactgtgggggtactgcatccaggggaactcgaggttcctcatatactcctacatggagaatggcagcctggatgattggcttcacaacagggatgatgatgccagcacatttcttgactggccgacgaggctaaggattgcgcaaggagcaagccgtggcctttcttatatccataatgactgcaaacctcac

SEQ ID NO: 642 - DNA, 593 bp, Zea mays
  misc_feature (100)..(100): n is a, c, g, or t
  misc_feature (106)..(106): n is a, c, g, or t
  misc_feature (368)..(370): n is a, c, g, or t
  misc_feature (397)..(397): n is a, c, g, or t
  misc_feature (473)..(474): n is a, c, g, or t
  misc_feature (492)..(496): n is a, c, g, or t
  misc_feature (514)..(518): n is a, c, g, or t
  misc_feature (567)..(570): n is a, c, g, or t
  misc_feature (574)..(588): n is a, c, g, or t
  unsure (1)..(593): unsure at all n locations
gtaacagaagtcactgagctggaagaatcgcctgggctctcagcctcagccttggatgaggaacccaacgcttgtgttcaagcagtgcttctcagggagncaaacncactaggacacaatcaaagaactgtagttcctagatcacagcatgcatctaatgtactggctggaaatgagttggtgattgttggacctcgatatgctggttctgtgccacccattgcaacaagaggtctggaaaacagcaaggagagcggtggaaggggcttcaaacccaaaccttgtaacaacattttccaaaatggctcttcaaagcctgaaagggaaccgggcaattcgtcaaacaaaagaacagctggtaaaacggnnnaggaccttggtcacaaggatagttcanctgaagtgtcctacgagtactgtgtaagggtggtcaggtggctggagtgcgagggctacatcgagacaaacttcanngtgaagtttctcacatgnnnnngcctgcgtgccaccccgnnnnngagaaagatagtcggtgtctatgtggatacccttattgaggaccctgtnnnncttnnnnnnnnnnnnnnngacag

SEQ ID NO: 643 - DNA, 593 bp, Zea mays; identical to SEQ ID NO: 642
  misc_feature (100)..(100): n is a, c, g, or t
  misc_feature (106)..(106): n is a, c, g, or t
  misc_feature (368)..(370): n is a, c, g, or t
  misc_feature (397)..(397): n is a, c, g, or t
  misc_feature (473)..(474): n is a, c, g, or t
  misc_feature (492)..(496): n is a, c, g, or t
  misc_feature (514)..(518): n is a, c, g, or t
  misc_feature (567)..(570): n is a, c, g, or t
  misc_feature (574)..(588): n is a, c, g, or t
  unsure (1)..(593): unsure at all n locations

SEQ ID NO: 644 - DNA, 423 bp, Zea mays
  misc_feature (25)..(25): n is a, c, g, or t
  unsure (1)..(423): unsure at all n locations
ttcttcctatatatcagcaggtatntatttgtgaattttcatttataatggtgtacgcatatttaaatttcgagtgtaaggaagtgcagcacaaggttaattttcaggcatgacgacatctgacacatttctattgagctccagggtttaattagtgggtcggccgagacaaaagaacaggcagctgaaggtctaggagagttaattgacgtaacaagtgagaagactcttaaggaagttgtagtgccaattacagggtatgtgttttatccttttgaaattgcttcagttttgtgattgcccttttgaatggttcacatatgaggatttgtgctgtttgaggaaagcccaacatcattgcaaccatgaggcatcccaccacatgtccagctgacagccgaacagctccttaagatctcaacc

SEQ ID NO: 645 - DNA, 706 bp, Zea mays
  misc_feature (695)..(695): n is a, c, g, or t
  misc_feature (699)..(699): n is a, c, g, or t
  misc_feature (701)..(701): n is a, c, g, or t
  unsure (1)..(706): unsure at all n locations
gccacaataaccacaatggcaaggttagcagaccgcattggcaccagaactgactgacgatgggcagattcgaaatggcaaccaccttgatgacagggtcgtccaggcacgagaccgtcccgaaccactcggcgttggcggtggagccacccagcggggtgtgcgcggtcacgcagatcccgtgcttctggcagaacttgacaagagagtcgcgctggaagtaggggtgcgtctcgatctggttcaccgccggctttatcttggcgtaggccaggcagtctctggtgaggaagatgtcgtagttgctgcaccagtcactcgacaattgcccccagtattactatttgctgtaaaagcgactccctctaccatgaaaagtacgtaggctggaaaactccaagaccaggggggcaaaaaaaaaatggaagcaagaaaatttctacctgattccaatgctgcgcaccagccccatggaaacaagctcttccatcgcgtgccatgtcgtttccagggagatagtggtgtcgatgtccagcacgccatcgtcacccagagcgctagaagtcgtgccgactcctgggagaaacacacgtctcggtgaggtagcaagtggatgatctttctaattgttatgcagagagcagagggcgaggaacttaccggtgtgccgagtggctactgggaaatggatgagntagngntcgag

SEQ ID NO: 646 - DNA, 484 bp, Zea mays
  misc_feature (1)..(9): n is a, c, g, or t
  misc_feature (14)..(16): n is a, c, g, or t
  misc_feature (429)..(434): n is a, c, g, or t
  unsure (1)..(484): unsure at all n locations
nnnnnnnnncctgnnnagtatgcacgcatcgtcatcaatgcagtttctagtttttttttcaggacctagttttcacttcatcaaatttatgtgcagatatgtggcagtgatgaattcaatattttctgctcaacgttccatggtatcacatcaattgcttaatccattttagtcccattgagatttattgatcttttcgtttcaccagccagtcactatgttgttacttattactccttctgtcccagtatataaggcgtaaccacctctggctcaaagaccaagaaatgtatttaattctctctatacttttgcatcgatgtacgcatgtctagagataatacgccttgtattatgggactagaataaaaagtagttacaccttatacactaagatagagtaagtacttaatatccaaatttgacacnnnnnntgggttcagaaagagcaagacattggaatgtgcctatgtagatatgcatc

SEQ ID NO: 647 - DNA, 255 bp, Zea mays
aacagatccgtttcgccgatgtggggtgcggatttggcggtttgcttgtagggctctcgcctctcttcccagatacgctcatgattggcatggagctcagggacaaggtaatcctattattttgccttttatttctcccttgatttatttggacgccttgtagactgttccaagcttaaagttactggtagtattatgaagataaacaatgcgtttgacatgcttttgaatataaaaatgttaaaatcttagaaa

SEQ ID NO: 648 - DNA, 1170 bp, Zea mays
  misc_feature (15)..(20): n is a, c, g, or t
  misc_feature (23)..(24): n is a, c, g, or t
  misc_feature (56)..(58): n is a, c, g, or t
  misc_feature (375)..(375): n is a, c, g, or t
  misc_feature (501)..(503): n is a, c, g, or t
  misc_feature (570)..(573): n is a, c, g, or t
  misc_feature (767)..(767): n is a, c, g, or t
  misc_feature (789)..(789): n is a, c, g, or t
  misc_feature (795)..(795): n is a, c, g, or t
  misc_feature (800)..(800): n is a, c, g, or t
  misc_feature (829)..(833): n is a, c, g, or t
  misc_feature (840)..(840): n is a, c, g, or t
  misc_feature (861)..(861): n is a, c, g, or t
  misc_feature (922)..(935): n is a, c, g, or t
  misc_feature (945)..(945): n is a, c, g, or t
  misc_feature (956)..(956): n is a, c, g, or t
  misc_feature (959)..(959): n is a, c, g, or t
  misc_feature (985)..(986): n is a, c, g, or t
  misc_feature (1003)..(1003): n is a, c, g, or t
  misc_feature (1018)..(1018): n is a, c, g, or t
  misc_feature (1039)..(1039): n is a, c, g, or t
  misc_feature (1121)..(1121): n is a, c, g, or t
  misc_feature (1125)..(1129): n is a, c, g, or t
  misc_feature (1133)..(1142): n is a, c, g, or t
  misc_feature (1144)..(1146): n is a, c, g, or t
  misc_feature (1158)..(1160): n is a, c, g, or t
  misc_feature (1163)..(1167): n is a, c, g, or t
  unsure (1)..(1170): unsure at all n locations
aattgcaaaagagannnnnnatnnattttttacagaccgcgaaggtagaagaaacnnngaatgcctttcctgggggattgacaaagaacgagtccttcgtgggagaactggcattgaggtattgggtcacacttggtaaattttctcctctcttcatcttttgacaagaaataggagcaccattctccttatattactttggttagatcttagattgtcattttcccatctttctgcactgtggtacctacaatttaatttagaagatagcaaaaccattttccttgtattgaaacacttaactttagtgtaccttctacctagctttgtttgaatgccatactataaatgaagaaaaaaactagtacaccgagncttaacaagatcatctgcaggtctgttttgatttcatgaggagtttccatatggaattcagaaacttatctgaagagggccttgtttcttctatcgaaattggattgggtgcttcaggggagctannntatccttcatgtccagaaacaatgggctggaaatatcctggtattggtgagtttcaggtatttactnnnngtacttaaataccaagttgaaatttgcaaggggtttatttgggagtaatctttggaatccacctaaactcttacgatctggacataaacaagctctgtttgcattcagtatctgtgtcataataattcttaaataaacatggtttttggtgcatcaacatgtcaagcatgggatatttaagctgctgtcctttntacaagggactagttcttgcanttgganaaagngacatgcctcacaagagatctcttaaaannnnncaagtantaactaataaaactacatttnaaataggttattaaacacagcaacagatttgatcgctatacatcaccatgtctctgtctgnnnnnnnnnnnnnngtgtgtgacntggcttactantcnaattcaaagactgcatatttggtgtnngatagtgtaatgcatanggtatacattggctncatttcctttgttgatttccntcgttgacagtgttatgacaggtacatgcaaaagaatctacggcaatcagcattgtcccggggtcatttgttttgggcacgngggnnnnntaannnnnnnnnntnnnttcaagaccacnnnaannnnnttt

SEQ ID NO: 649 - DNA, 1273 bp, Zea mays
  misc_feature (157)..(159): n is a, c, g, or t
  misc_feature (178)..(180): n is a, c, g, or t
  misc_feature (270)..(277): n is a, c, g, or t
  misc_feature (283)..(285): n is a, c, g, or t
  misc_feature (300)..(300): n is a, c, g, or t
  misc_feature (302)..(306): n is a, c, g, or t
  misc_feature (311)..(313): n is a, c, g, or t
  misc_feature (315)..(317): n is a, c, g, or t
  misc_feature (319)..(323): n is a, c, g, or t
  misc_feature (334)..(335): n is a, c, g, or t
  misc_feature (337)..(338): n is a, c, g, or t
  misc_feature (348)..(348): n is a, c, g, or t
  misc_feature (350)..(362): n is a, c, g, or t
  misc_feature (365)..(374): n is a, c, g, or t
  misc_feature (379)..(395): n is a, c, g, or t
  misc_feature (399)..(405): n is a, c, g, or t
  misc_feature (411)..(425): n is a, c, g, or t
  misc_feature (428)..(438): n is a, c, g, or t
  misc_feature (440)..(440): n is a, c, g, or t
  misc_feature (452)..(452): n is a, c, g, or t
  misc_feature (455)..(582): n is a, c, g, or t
  misc_feature (584)..(611): n is a, c, g, or t
  misc_feature (620)..(632): n is a, c, g, or t
  misc_feature (652)..(652): n is a, c, g, or t
  misc_feature (657)..(659): n is a, c, g, or t
  misc_feature (667)..(671): n is a, c, g, or t
  misc_feature (675)..(677): n is a, c, g, or t
  misc_feature (764)..(764): n is a, c, g, or t
  misc_feature (768)..(768): n is a, c, g, or t
  misc_feature (806)..(808): n is a, c, g, or t
  unsure (1)..(1273): unsure at all n locations
cagagcgttctaatttgcttcttcatatagtaagcactagcaaacttgtccatcaaatagtaactatacagaccagcattacacaccttcacaactatttctgctccgtcaaatgcaagagtagcaagcgacagcacctgatcgacatgatccatgnnnactccagagtaccagttannnaaaaaacgtccatagtagctgtcatagtcgcctccatcacaaaaaaagccagtttcatgtggtcttgaattataatagccagcgttatcnnnnnnnngtgccnnnaacaaatgaccccgngnnnnngctgnnngnnntnnnnncttttgcatgnncnngtcataacantnnnnnnnnnnnnnatnnnnnnnnnnaatgnnnnnnnnnnnnnnnnnatgnnnnnnnctatcnnnnnnnnnnnnnnnagnnnnnnnnnnngnctagtaagccangtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnngacagcagnnnnnnnnnnnnntgcttgacatgttgatgcancaaannncatgtttnnnnnagannnattatgacacagatactgaatgcaaacagagcttgtttatgtccagatcgtaagagtttaggtggattccaaagattactcccaaanaaancccttgcaaatttcaacttggtatttaagtactagtannnaatacctgaaactcaccaataccaggatatttccagcccattgtttctggacatgaaggatatcttagctcccctgaagcacccaatccaatttcgatagaagaaacaaggccctcttcagataagtttctgaattccatatggaaactcctcatgaaatcaaaacagacctgcagatgatcttgttaagcctcggtgtactagtttttttcttcatttatagtatggcattcaaacaaagctaggtagaaggtacactaaagttaagtgtttcaatacaaggaaaatggttttgctatcttctaaattaaattgtaggtaccacagtgcagaaagatgggaaaatgacaatctaagatctaaccaaagtaatataaggagaatggtgctcctatttcttgtcaaaagatgaagagaggagaaaatttaccaagtgtgacccaatacctcaatgccagttctccc

SEQ ID NO: 650 - DNA, 740 bp, Zea mays
  misc_feature (327)..(327): n is a, c, g, or t
  misc_feature (556)..(556): n is a, c, g, or t
  misc_feature (593)..(593): n is a, c, g, or t
  misc_feature (603)..(603): n is a, c, g, or t
  misc_feature (632)..(632): n is a, c, g, or t
  misc_feature (644)..(644): n is a, c, g, or t
  misc_feature (649)..(649): n is a, c, g, or t
  misc_feature (692)..(692): n is a, c, g, or t
  misc_feature (734)..(735): n is a, c, g, or t
  unsure (1)..(740): unsure at all n locations
gaggatgagatggtagaagaaactctagcatcccataatcgacaggccatgacatatgcttacctttgtgggggcacagcaccgccagaagtgcacttctataggagacccttccggcacatagatgggttttctcaatgggaagaagatggggaacctgacagtgttacggcatgaagatacagttattgatggcgaggtttgagagattctatttccagcttttgtaaagatcaggttgcaggttaccagctaaacatgtttggtgtagctgtgtttggctcgattccaagatgaacatctttataaagtacagagtcaaaatanccagcaaatcctgccaaattgatgcgggatagtcgtgtgagggacaacttatttatctatggtaataaacaatatgaataataaattgcaagtagagtatggttgcataccatgcacaaggcatgaacccatatctggcagcatttcaaattgcaacttggtgtacctttggttgctagcatttggtgagaaatttggatgggtgaaagtaaaaacctacacaagtaanggtgatcaccaaatttcatgtcacaaatagcgaatgnaatatggcantgtgtaaaactgtgatatgatctgaaccnatgaaacacacncggcnggtctgatctctcacctgttgtggaggtgcaagtgtcgctatncggtgtagtttgacaacatatgcggtttcaaaatgtgcaatnnctttg

SEQ ID NO: 651 - DNA, 781 bp, Zea mays
  misc_feature (10)..(11): n is a, c, g, or t
  misc_feature (235)..(235): n is a, c, g, or t
  misc_feature (276)..(276): n is a, c, g, or t
  misc_feature (430)..(430): n is a, c, g, or t
  misc_feature (657)..(657): n is a, c, g, or t
  misc_feature (681)..(681): n is a, c, g, or t
  unsure (1)..(781): unsure at all n locations
acacaaccanngaacttacaacttccaacagggtatgtgcatgtttttgcatgaaacagcaacagcaaccactttatctgacggaggtaatgaatatttctcttgacctgcccaaaccctccagttgtgggctttggcactgcaggatcaacagaagcgagagtgccattagaaagacaccaatctgatgaaaatggttgctgtactccatcttgtgacattattctttgacaanaatcttcttgtacttgtttttcgagtgatgaattagtagcnacaggagccttttccattgtttgtggctgccattgagaaagcagcatttgctctgtctgtgatcctttcagcacataacttacagcatttgaaccgttatcaagctgcggattagagggcaacaattgctgagaaccatgtgaggcagaaggangaaaattttgagagctagatagatgaccaagcatctgccctcctttaacattgtcaagagcatttctttgctggtattgaccctggaagtttggaaggtcagcaggatcactagcttgtgaagaaactagttcagtgtgtggcagagtcccctgttctggcagttgcattgaatggttggaagccatttgagactgtttaagggaattgttccttaacatagcctgntgatgctgtgaatttggctgctgntgatttatatgatactgattttgaataaactgggaattaggttgcacctgatgctgcgacattgggtgctggtgtagtagttgatcatgagtcaggggta

SEQ ID NO: 652 - DNA, 1093 bp, Zea mays
  misc_feature (76)..(76): n is a, c, g, or t
  misc_feature (127)..(127): n is a, c, g, or t
  misc_feature (149)..(149): n is a, c, g, or t
  misc_feature (222)..(222): n is a, c, g, or t
  misc_feature (274)..(274): n is a, c, g, or t
  misc_feature (320)..(320): n is a, c, g, or t
  misc_feature (435)..(435): n is a, c, g, or t
  misc_feature (743)..(743): n is a, c, g, or t
  unsure (1)..(1093): unsure at all n locations
cccgttctccgacagtgtcaggattgcggtggacaggtctatttgcagaggggagtcccttggaaatgcctgacanagtgagttttgtaagagctatgtttaaattaataatgaaacaaagttgctnaattctggatattagacttctnctgcaaataagtgcaaggaaggctccataatctcagagaatgtgaccctttctagggatgacccgcgggtacncgcgtgtttcgtatccgatgtatgtgggcacaagcatgaaagcttacccacnggtacgctttcaggctggtaaaagttagggtcgcaggtatactcgngtgcggataaatactttaccgcaccatacccgacccgctgccatccctagccctttctcttaagaaaaactaaccttagagtgtaccataagctatgtgaacagtagacgggttnctcgtagttaatgctgtgacactactctgataatattgaatggcttataagatatgtttctatttatatttctactagaatagaatgtatttcaggacaacttaaagttcaatgcacttacaaagccccatccaccgctggtgaaatctgagccagcaacagcaatcttgcagtaagttgacaaaaacagctcaacataggggcgctcatcaacaatagccataacacctcctttcttgggacctagcttgagattttcagcatactcttcaggagaaccaagagcttttagcctcgactgtgagatnttcagttccttaatcatgtattcttcgacaaaagaaccaacttggaaaccaataggataatcactatttttcaggtcatcaagtcctcttatagatgtatcaagctgttgcacggttaggatggaagtaagacttgcagtgtagcttgattgaatgatcaatacaacaaatagccatatgagcaaaacaccacgtcctaaggtactcattgtgttttctcctggtaataaaaaaataagagtagaggtaccacgtgagaacagagggtcagttactcagttatactgaaggacagaacaggaaaggctagtttactcactatgtgcaaaaaacagagtcgaaaaactgaa

SEQ ID NO: 653 - DNA, 733 bp, Zea mays
  misc_feature (67)..(67): n is a, c, g, or t
  misc_feature (128)..(128): n is a, c, g, or t
  misc_feature (341)..(341): n is a, c, g, or t
  misc_feature (397)..(397): n is a, c, g, or t
  unsure (1)..(733): unsure at all n locations
gcagcagcctccaagtgctcaccctcagcgacaactacttcagcgggcagctgccgcgggcagtagncaacctgtcgacgacgcttcagcagctctacctccacaacaacagcatctccgggagcatnccggagggcatcggcaacctggtcggcttggacctgctctctctggggataaaccccatatctggcgtgataccggaaagcttgggcaggctgacgaacctggtcacgcttggcctgtacagcactagcttggcaggccacatcccggcttctcttgggaaccttaccaatctggtttacctagatgcacacaactcagatctgggaggcctnatcccagccagccttgggaagctgcacaaactagtcctgctggatctgtcacacanccgtctcaacggctcggtccccagggaaatcctcgagttgtcctcgctttctttgtcactggacctgtccaacaatttcctctccggacccattccatcagaggtcggcgccctggccaacctcaacaccttgagcctgtcagggaaccagttcaccggcaacatacctgacagcataggaggctgcgaggtgctggagttcctctcgcttgacaggaacacgttagacggaggcctgcctcaatccttgggcaagctgaaagggctcaacgtactcaacctaaccatgaacagcctatccggtaggatccctgacgccctgggcagcatcggcaa

SEQ ID NO: 654 - DNA, 501 bp, Zea mays
tgcaaaaatgtgataagcaagctttggaggaggattgacaaagaaggtcatcaaatgatacccaatatatcttcttggtggcggaggaatgaaaattcctcattgagaggtccggctggtaggggtagcacccttgacctagaaaaaattgaagagcgagttgatggattggagtatggtactgtaactggagttcatatatagcggacatgcagcagacgttgaaaagtgtggttcagcacttcagctgtaggcatgagctatcaaacattgtgccatctattgtgtatatgcttctacctgttatggatattgatgctataagatgactaatctactccatccgactacatgatgcaggtccggatagaggctgagaccctccataacttgtttttcaacataatgaagatcgccttcccagattcagacttcagcgaagctaagaacgcaatgtcattttcgagtcccggaggatctgcgagtggtggcgctgctgct

SEQ ID NO: 655 - DNA, 420 bp, Zea mays
  misc_feature (327)..(332): n is a, c, g, or t
  misc_feature (366)..(366): n is a, c, g, or t
  unsure (1)..(420): unsure at all n locations
cctgcccacgcagaagatcggcctcgtccagccgctggaggagctgctcatccactcgttcccgctgccctccttcctcatctggccgggctactacgtgctctaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaagnnnnnnacggcgagttcgggttcgccaccgtccgcgaggncatgccgctggtgcggtcgacggtgtacgagatgctgcggatgcagccgcccgt

SEQ ID NO: 656 - DNA, 716 bp, Zea mays
  misc_feature (3)..(6): n is a, c, g, or t
  misc_feature (299)..(299): n is a, c, g, or t
  misc_feature (572)..(572): n is a, c, g, or t
  misc_feature (655)..(660): n is a, c, g, or t
  misc_feature (690)..(690): n is a, c, g, or t
  misc_feature (692)..(693): n is a, c, g, or t
  misc_feature (699)..(707): n is a, c, g, or t
  misc_feature (709)..(710): n is a, c, g, or t
  misc_feature (712)..(713): n is a, c, g, or t
  unsure (1)..(716): unsure at all n locations
aannnnattggaatttacaaaatgataataatataaagacatgaaaccaggtcaatgatgtaagaggaaaaaggtattactgtggtctcttgtccagtaataccaaagtagtcggcaactggttcaccaacttcctcactgtctcgttccacaaagacaaataataactgcatatgtgtgaacacacctcgtcaatgactagcgaaacactcaaacaccaaaaagtattaaaaacaaaaaaagtacaaggaaaaaaaactgatgagttggaaattaacttgaacatagaacatggaacnaaagcaaaggataaaagttcaaacaaaatctgtgggttaacaatgtaagcgaggttaatcgcatggtattagattgaatgagcctctcaggcagtatacagagagtacaaagacactatggcagtaccagattacaaccctaattgccaaacatactgtaacatccccccacaaacataacggggccatcataaatggacagactgaggttaacagcgtgagattagattgattgaacctcccgggcggtatatatagagtatagaaacttanggggcaagttgcatccctagatacatttatgacaataccggattgcaatccctagattacctttcccttaaatggttttgctnnnnnnttaaagatgggcagaaatttggtggactcncnngcaacnnnnnnnnntnnannctg

SEQ ID NO: 657 - DNA, 710 bp, Zea mays
  misc_feature (53)..(53): n is a, c, g, or t
  misc_feature (223)..(223): n is a, c, g, or t
  misc_feature (243)..(243): n is a, c, g, or t
  misc_feature (305)..(305): n is a, c, g, or t
  misc_feature (319)..(328): n is a, c, g, or t
  misc_feature (341)..(341): n is a, c, g, or t
  misc_feature (362)..(362): n is a, c, g, or t
  misc_feature (389)..(389): n is a, c, g, or t
  misc_feature (473)..(473): n is a, c, g, or t
  misc_feature (502)..(502): n is a, c, g, or t
  misc_feature (642)..(642): n is a, c, g, or t
  misc_feature (644)..(645): n is a, c, g, or t
  misc_feature (678)..(687): n is a, c, g, or t
  misc_feature (689)..(697): n is a, c, g, or t
  misc_feature (699)..(699): n is a, c, g, or t
  misc_feature (701)..(705): n is a, c, g, or t
  misc_feature (709)..(709): n is a, c, g, or t
  unsure (1)..(710): unsure at all n locations
aatataagcttttgacttgttagctacaaagtctaaagggatgacactaaaanatatactcaacttaccagcgagatgtttcatagggattccagcaaatgcaagagcagcacaagaagcattaattgcacatgacataagctaagcactgtcaaggaaacaaggactagcttcgattgaaaaaagaagctactcatattttgagttaaaaggtcttggagtncgcatgatgttttggcaacnaactacatttcaaggaagagccaaagatatccgacaaagattcaactctctctaattccaancctagttgatgtgnnnnnnnnnntcatgccttcatncattattccctataagttacnacctaattgatcctagcaaatttatcnaaaaaaccattagctaacagtcagtagactaaaatttgaagctttaatattgaatgcaggacaacaaacgcaataaacataaangcagtcaaactatattactgctacatcangtggaaagatacagaaccatcatcacccacaacctgcaatagcaagattaacaatggataagtgacatttagtggtatgagcacggacaacggtagccaacataagagaatgtacaatgggtgtgcttagagatgatgantnnccaaaaaaaccttttggaagtggggatcctatnnnnnnnnnnannnnnnnnncnannnnnactnt

SEQ ID NO: 658 - DNA, 255 bp, Zea mays
cagcaccagaagacaacgaaatgaaacactcaacaaacatacatcaacacactaaatggcgacatctagtacctccttcaggatatatggagttgtagtgcacctcagcccaaaaactcaagcatataactgcacaacaggacttctgagtttagatagccaaaacctctgctcatcaacaaaaacacccattgggaaatatgcccgagatatatacagagtgagaaggtttacttaggcaaacaatactcagat

SEQ ID NO: 659 - DNA, 469 bp, Zea mays
  misc_feature (80)..(80): n is a, c, g, or t
  misc_feature (147)..(147): n is a, c, g, or t
  unsure (1)..(469): unsure at all n locations
cctactccccgcccccgtcgccttccgccgccgtcttttgcgctaacgcttcgcctttcgatcccctttctgacttcttntagcatcatcccaagtcctcgcccggactccgcagattctctggttgctacgagttcttcgcctggnttttgggcaaggtgagctgctcctttctccattcctctggaaatgttccgtttgcttccccttttccttctcgttctggccttctgattgctgacggctcaccttttcgcaggccaaaatttctgatttttttccaccgccgcaaacccctttcctgtgccataccgccattccattcctaagctgggcgtgggcgggtgaagaaaggaagcgaggccggctgtttcgctgaaaccccgccgcctttttttccttttcttttctggacctgattgaagaaccgtagcagattaggggagggaggagcggcggcggccggtcg

SEQ ID NO: 660 - DNA, 741 bp, Zea mays
  misc_feature (201)..(201): n is a, c, g, or t
  misc_feature (295)..(296): n is a, c, g, or t
  misc_feature (301)..(301): n is a, c, g, or t
  misc_feature (308)..(309): n is a, c, g, or t
  misc_feature (329)..(330): n is a, c, g, or t
  misc_feature (627)..(627): n is a, c, g, or t
  misc_feature (643)..(644): n is a, c, g, or t
  misc_feature (667)..(674): n is a, c, g, or t
  misc_feature (693)..(697): n is a, c, g, or t
  misc_feature (709)..(712): n is a, c, g, or t
  misc_feature (730)..(730): n is a, c, g, or t
  misc_feature (732)..(738): n is a, c, g, or t
  misc_feature (740)..(740): n is a, c, g, or t
  unsure (1)..(741): unsure at all n locations
atggcacaagcttgggagccatccaccagttggtccgtgtaagtacccacccttgtctactgcttggacgtgtaccctttctgtatggttctgctgacagatgctgtggagataagatcctcaaaaaaaatggtcatgttgcaatgctaaattgcgcattgaaatgaacaacaaagattggataaatacagcaatcatacntgaatggctttctgcacctataaatttgttcgcaatgaaagatgtagaggttatctataagccaattgctagatcataaatcaatggtttttcnncactnctgtatnngacacacatgcacacacacnngaacacagcatcttcagtggtggaaacgcttgatatctacttcgacttgttttaagtttggagcaactgaccaaagtaccaacctaagtacatgacttgtcaaaccaatcgccaggtcacactgacgtggtaatgccttaggctatctccaacacatcctcatattcaaactccactccgtgaacaatgcatgcagtgaactgctggtgtcttggttgtgcaacctgtattttcagacagtatgacggcctaagaacactggaaccctgaaacaatcctgaatccttagatgaccangtttctgctgcaattnngcacgccacacatgcctttttcnnnnnnnnccgcaatctgcacccattnnnnntctgaatttatnnnngagaggatgatggaatgncnnnnnnngng

SEQ ID NO: 661 - DNA, 727 bp, Zea mays
  misc_feature (14)..(14): n is a, c, g, or t
  misc_feature (17)..(17): n is a, c, g, or t
  misc_feature (85)..(85): n is a, c, g, or t
  misc_feature (129)..(129): n is a, c, g, or t
  misc_feature (133)..(133): n is a, c, g, or t
  misc_feature (343)..(350): n is a, c, g, or t
  misc_feature (360)..(360): n is a, c, g, or t
  misc_feature (372)..(372): n is a, c, g, or t
  misc_feature (386)..(386): n is a, c, g, or t
  misc_feature (399)..(406): n is a, c, g, or t
  misc_feature (415)..(415): n is a, c, g, or t
  misc_feature (553)..(553): n is a, c, g, or t
  misc_feature (578)..(578): n is a, c, g, or t
  misc_feature (585)..(585): n is a, c, g, or t
  misc_feature (609)..(609): n is a, c, g, or t
  misc_feature (690)..(691): n is a, c, g, or t
  misc_feature (720)..(721): n is a, c, g, or t
  unsure (1)..(727): unsure at all n locations
ggctgatatctacnaantagtatgatatgggaagtatctagtctagttccgataatggtggaacagtgtaatcgcccttccaaanttcactgtggcgcaaaccaattccagatagcttcattttagaanctgnttatatcaactatttgctggctaatgtgatttaatcgccttttccaaggacgagatacttgaggtggctggcaaaatatacaaggcaggaatgtcccttcttgtcatcgacactgagaacaagtttgtatccacgggatttgccaaggaaattgcaagggttgcccagggtacgcttgaaatggcaaatccatctaatgcttttgacacnnnnnnnnccagatatcncaatccagtttncccctgttgaactntcctgaatgcaannnnnnnnctgccttcntctgcacagggaaatattattacctccctaatgcttcagatgctgtaatttctgctgccaccaagaccgccctgacagacttgaagagctcatgattttgcagcagcggcacccgttttctgtaccttttgatagggntggtgaaccttcattcatgcagtantttttgngtaggcctctacaatgacaggggnaaacaaacccgagcatggcatcgtgtaaagtgttaaggtccaatggcctcctgtccacgtttggcgatgtaaatcctccgnncatagcttgaaccattgagtgtcacgtanngccgtg

SEQ ID NO: 662 - DNA, 667 bp, Zea mays
  misc_feature (34)..(34): n is a, c, g, or t
  misc_feature (49)..(49): n is a, c, g, or t
  misc_feature (442)..(442): n is a, c, g, or t
  misc_feature (444)..(444): n is a, c, g, or t
  misc_feature (446)..(450): n is a, c, g, or t
  misc_feature (525)..(525): n is a, c, g, or t
  misc_feature (536)..(537): n is a, c, g, or t
  misc_feature (568)..(569): n is a, c, g, or t
  misc_feature (571)..(571): n is a, c, g, or t
  misc_feature (590)..(592): n is a, c, g, or t
  misc_feature (595)..(597): n is a, c, g, or t
  misc_feature (603)..(604): n is a, c, g, or t
  misc_feature (610)..(610): n is a, c, g, or t
  misc_feature (615)..(623): n is a, c, g, or t
  misc_feature (625)..(628): n is a, c, g, or t
  misc_feature (638)..(638): n is a, c, g, or t
  misc_feature (644)..(652): n is a, c, g, or t
  misc_feature (656)..(664): n is a, c, g, or t
  unsure (1)..(667): unsure at all n locations
taccctggccgctcagtcgctggagcccgggccnggcgtcttggacccnattccgtacttctcctggagcctggtgatctcgtcctccttcttcttgatatccgacttcttggacatcttggcgggctggtagtagagcacgataaggtagcggttggcgacgttgaagccggagaggtggtcgacggcgttcttggcgtcgtagatgtcctcgtagacaacgtaagcggtcccgcgcgtgtccttggcgttgcccagacggatctgccggatcgcgccgtacttgccgaagatgtcgtacatctcctcgctcgagatgttgaacggcaggttccgcacgtagagcacccggttcacctccggcgggaggcgcgcattccccttcctcaggcccgccgccgccatcgctgccgcgccgagataacctagggtttggggattngngnnnnntatgctttgcttgttgcgtatggccacctcttcctctcgcgcttcgggtggagccggcgcacggggtcgattagntgccgactccnngagagttcccaccgacatgtggcccttactnntnaagcggggcccatatgtcnnngtnnngtctcnnagcttngtttnnnnnnnnnannnngacctgagtnctgagnnnnnnnnngccnnnnnnnnnctc

SEQ ID NO: 663 - DNA, 679 bp, Zea mays
  misc_feature (249)..(284): n is a, c, g, or t
  misc_feature (462)..(462): n is a, c, g, or t
  misc_feature (464)..(464): n is a, c, g, or t
  misc_feature (468)..(473): n is a, c, g, or t
  misc_feature (487)..(488): n is a, c, g, or t
  misc_feature (541)..(541): n is a, c, g, or t
  misc_feature (549)..(550): n is a, c, g, or t
  misc_feature (559)..(570): n is a, c, g, or t
  misc_feature (572)..(575): n is a, c, g, or t
  misc_feature (579)..(581): n is a, c, g, or t
  misc_feature (585)..(587): n is a, c, g, or t
  misc_feature (594)..(612): n is a, c, g, or t
  misc_feature (614)..(678): n is a, c, g, or t
  unsure (1)..(679): unsure at all n locations
ggcggccaagcacaaggccgtggtggtgctgggcgccacgggcaccggcaagtcccgcctggcgatcgacctcgcgctgcgcttcggcggcgaggtcatcaactcggacaagatccaggcgcacgccggcctggacgtggccaccaacaaggtgggcctcgccgagcgcgggcgggtgccgcaccacctgctgggcgtggtgcacccggacgccgagttcacggcggccgacttccgccgcgaggcctnnnnnnnnnnnnnnnnnnnnnnnnnnnnnnnnnnnntgcccgtcatcgccggcggctccaactcgtacgtggaggagctcgtcgagggggaccggcgcgcgttccgggaccgctacgagtgctgcttcctctgggtggacgcgcagctccccgtgctgcacggcttcgtcgcccgccgcgtcgacgacatgtgccggcgcggcctcgtcgacgngntggnnnnnncgttcgacccccgnngcaccgactactccaggggcatctggcgcgccatcggcgtgccggagctcgangcctaccnncgggcgcgnnnnnnnnnnnncnnnnaccnnnacgnnnagatgcnnnnnnnnnnnnnnnnnnngnnnnnnnnnnnnnnnnnnnnnnnnnnnnnnnnnnnnnnnnnnnnnnnnnnnnnnnnnnnnnnnnna

SEQ ID NO: 664 - DNA, 641 bp, Zea mays
  misc_feature (60)..(60): n is a, c, g, or t
  misc_feature (62)..(63): n is a, c, g, or t
  misc_feature (112)..(112): n is a, c, g, or t
  misc_feature (202)..(202): n is a, c, g, or t
  misc_feature (268)..(268): n is a, c, g, or t
  misc_feature (572)..(572): n is a, c, g, or t
  misc_feature (637)..(640): n is a, c, g, or t
  unsure (1)..(641): unsure at all n locations
agagttttcacttacaagcatgtaaggaccaatcagtcgaaactggtgcatatatcctananngtccagactttctatcacttatttgactatgtacagctcaatgtccagnccatgtaaggtgtactagatagtatgctgatctatcatatttggatctgttaaactatctggtagatcaaaccatctgaatttcaatgtnttagctagtttaatcacggaccttagtttctggaatagcatgtaagcaacagtttggattggtatnacacaacatttgggtggaatccccgcctgctgggaaatcggcaatccatcaaacatatagtgggcaagcaccagtatagaactatcatttaccgaaagggacgacaagacaagagcatagacgaagaggattgttaaacaatacgaacccaagaacggataggatggtgaggcggactggatggagccgcagccaatacccaacggggatcgccccccgcagctcgatcaccggcagcgtcgcgagcgcgaacacgacggtgtcgtcgggccatccgagcctccgcagcgactccgccacccgnagcccgaatcctgacgccttgatggagtcctccgccgctgcccgcgccgcgccgcagccgagcgnnnng

SEQ ID NO: 665 - DNA, 851 bp, Zea mays
agatcaaacatggttcaaaaaactgctgaataagaagatagaggactgtaatgagtggaaatgaaaagtgaaaaaaacacagatctaaactaagtgagaagaaccataacaataagcacaagcagcaggcataattcttctgctatcagaagcatgttactgaagttcaaagcaagcagataccttaagaaaaaagcatatgctatataacatgcaccatccaacttatactacaatacagtggcatggcagctgaaacttaactaaaaataccacatgccctcagcaccgccaaactacagcacataatctagcttaacacaatcagccctctttgaacctgtggttaccgattgcttgcaaccaaagaaaatgcatagcattgaaaacaagagataagaagaccatttgaagctgatcggacaatcacagagagacatgtgacaaatggttgcccgagcatgtcagcctacatgaactgtaaattactcagcaaccgatttgtaaaccacggaaaacactgaatcgaaacctaaaaacaatactaaatatgcaggttataacttatacagatcacacatcacagcaacatcaattctgaaaccaaggactcaggcggccaagccagacgataaaagttcagacttcagatatcgctttgttaccctctccgcgatgctgtgggggtcggtcgcctgcccacgccgcgcccgcacctttggcctcggtgccggcggttgtggcccgactgccgcaccgccttgcttcggctgctgcgcgtggaacacctaaaacccagccaggacacacaaaaacatggctcggttagggctgcaggtaaactatagagg

SEQ ID NO: 666 - DNA, 515 bp, Zea mays
tgctgcagggagcctgggaggaaaaggagcacgatcgctactgccttttgcatgcatgcgtgtagagcgagggagactactcattgctcattagtcaagcggtcaagcccaagtccttgttgactgtacctcggcttagcaaaagagagcaaggccaaacagaaaagccacgacaatgtgccttcaatccttcatcgtgccctggtttatgtcaacttctatattcgactctataatccgtacagtctatatataaaataatatttcatttatttatataatcgtgtgataatcttagccttaccaggactagaaaaaaaaagatatttttgctgagccttttttttttatgtttgtgcatatgtttcttatatcagatatcataaaataagtgattttgcaagtacctatggaagttcatgtctttgctcccgggctcgtatcgtattgtagcagctagccaaagctctgaatcattccttcctcatcatagttgaaatttggatacaaaacca

SEQ ID NO: 667 - DNA, 433 bp, Zea mays
ctaaccagacttggttttctgaggacctgatccttaactctatctttgaactgggagtcccgatcatgggtgtaagaatgacgccatcaacttttcttttggtcatttgttttagggtaagtatccgtggtacacttggtataatactggctgtcattgtcacaacttgttctctccttgcactacgcaccaacttatcctgctttttccctacttgacatgtattggtttgtcattcagttgatcaaaccgagcctgattgggattgcattctccggtgatacttacatgcgttcatgtccccatcacagccatctgtacatagttttatggtctctgtcacccatcttcagccaagacgagagaggtaggggggaagtttcttgccctccgcgttgatcaagcaaagagtagaaggaaacgctctttgcag

SEQ ID NO: 668 - DNA, 542 bp, Zea mays
  misc_feature (185)..(187): n is a, c, g, or t
  misc_feature (447)..(447): n is a, c, g, or t
  misc_feature (473)..(473): n is a, c, g, or t
  misc_feature (477)..(477): n is a, c, g, or t
  misc_feature (497)..(497): n is a, c, g, or t
  misc_feature (503)..(503): n is a, c, g, or t
  misc_feature (515)..(515): n is a, c, g, or t
  misc_feature (518)..(518): n is a, c, g, or t
  misc_feature (530)..(530): n is a, c, g, or t
  misc_feature (539)..(539): n is a, c, g, or t
  unsure (1)..(542): unsure at all n locations
ctgatgcaaaagaacatgagcctcccaacagtcatgtctataatgcagttaaacagtacaaccttgcagattttggtgagaccaattcagatgccacactttttattattaaatcatatactgaggatgatgttcacaagagcattaagtacaatgtgtgggtaagcacccctagcagaaatttnnnaaaaaaaaacaactagacgctgtcaatttcctccgttgcctagagacttaagttagttccagttcttcgccgttcctttatcaatttcctccatatatagcccccgatcgatctgttgttgatagatctgaagaataaagaatgatacagttccataatgaagatttgttagtgctgaagaccaccggtgtctgatccttgatcgctactacggccaagcaataccatgcatgggtgaccatcatggaccgtgcaagaantacttcaaagtgatgcaggcagcacnggtnacgattcattgtttggcagntctggngcgttcatcttngcnaaccacgggtgnctgagcgcngca

SEQ ID NO: 669 - DNA, 675 bp, Zea mays
  misc_feature (216)..(216): n is a, c, g, or t
  misc_feature (337)..(337): n is a, c, g, or t
  misc_feature (357)..(357): n is a, c, g, or t
  misc_feature (387)..(387): n is a, c, g, or t
  misc_feature (395)..(395): n is a, c, g, or t
  misc_feature (412)..(412): n is a, c, g, or t
  misc_feature (426)..(426): n is a, c, g, or t
  misc_feature (462)..(462): n is a, c, g, or t
  misc_feature (468)..(468): n is a, c, g, or t
  misc_feature (507)..(507): n is a, c, g, or t
  misc_feature (534)..(534): n is a, c, g, or t
  misc_feature (539)..(539): n is a, c, g, or t
  misc_feature (552)..(552): n is a, c, g, or t
  misc_feature (565)..(566): n is a, c, g, or t
  misc_feature (583)..(583): n is a, c, g, or t
  misc_feature (585)..(586): n is a, c, g, or t
  misc_feature (590)..(590): n is a, c, g, or t
  misc_feature (628)..(628): n is a, c, g, or t
  misc_feature (630)..(630): n is a, c, g, or t
  misc_feature (636)..(674): n is a, c, g, or t
  unsure (1)..(675): unsure at all n locations
gcagctagagcggatgtatcagatccgtcgtcaacttcctggtacgcatcaggtttcggctgcgcgcattcttgatcaaaatcccacgaagcgtcctcttcacaggccggcacctctaaatcaatcacaaatgctcgtttaggatggttgttccgtgaaggttccacgtggcattcgtgtgacactactgattcctcagaattgtcatcatttggnacatcatcattgagatcgatgaagttcctgatgggggcgccacttttcttggtggctccttcagcggcttgtccatctttaggcacatgcttctggcacgaaagaggtaaacatgtagcancctcttgggctttattacanacaggcagagttccggtaacaatgttatcngaaggccnatccttcttaattgcanagccaacagatgtngaagcagaatctgacaaattccgaatagtcacagcnggttcnttctggtctttagtatttttcagctctattgcagttccnaatgaatgtccaaaaatcttccctggnttctncacagctgttggntcagcagacatanntttttttttgagccaananntccnaagtactgaccccccatctttatcatgctgaaaactgnangcacannnnnnnnnnnnnnnnnnnnnnnnnnnnnnnnnnnnnnnt

SEQ ID NO: 670 - DNA, 609 bp, Zea mays
  misc_feature (40)..(40): n is a, c, g, or t
  misc_feature (55)..(55): n is a, c, g, or t
  misc_feature (290)..(290): n is a, c, g, or t
  misc_feature (292)..(292): n is a, c, g, or t
  misc_feature (312)..(312): n is a, c, g, or t
  misc_feature (605)..(608): n is a, c, g, or t
  unsure (1)..(609): unsure at all n locations
gtacccctgtaagtatctgcagtcagaaacactagtgcangaccgcagaaaatgnttgtgaactgtctctgtgatgcagaaaatggcgaatgcacacaacttcatatgcggctttcccgaccaatataagactgtcgtcggcgagcgggggatcaggttatccggcgggcagaagcagaggatcgccattgcgagagctttgcttatgaacccacgagtgcttctcctggacgaagccaccagtgccctggatgctgaaagcgaatatcttgtacaggtaagcacgaacngncatctcctgatctgctggtnccagcaagaaacgaaccacactcttaaccgcgatctacttatcagttaaatgtgctttggttcttgcttggcgagctggaacgtgacgttggttttcccctacatgtgccacaggatgcaatggactccttgatgaaagggaggactgtccttgtgatagcccaccggctctcgaccgtcaagagcgccgacaccgtcgccgtcatctccgacggcctaatcgtggagagcggcacgcacgacgaactcctggaccgcgacggcatatacacggccttggtgaagaggcaggnnnnt

SEQ ID NO: 671 - DNA, 590 bp, Zea mays
aagagcttcagcaactagagcagcagctggagagttcactgaaacatatcagaaccaggaaggtagtgtgatcatgtatattagactgcagtgcattccttatgtgatgcctactacaccactgacagccttgcgctctgcgcgttggagaaagctaacaagtaaatattcatcgcatgcgcagagccagcttatgctcgagtcaatttcggagctccaacggaaggtaaattcgtcgagcttgcttaaagttggccgttggaacttcctttttaagaactgtaaggtttctttagctgggcattaggtgggcatggtttgttgcaagtattgactgctctggttgtctagttacatccacaaaatattcctgctcttgtgctgtgctgagtattggcatgcgatgcattgccgcaggagaagtcgctgcaggaggagaacaaggttctgcagaaggaggtagccagacgccgctgctcctcaacactcagctagccctctgttttctcatgacgcaaattaaatttacagaaagcgttgctcctgcctgcagctcgcggagaagcagaaagcccagcggaagcaagtgc

SEQ ID NO: 672 - DNA, 650 bp, Zea mays
  misc_feature (1)..(2): n is a, c, g, or t
  misc_feature (4)..(6): n is a, c, g, or t
  misc_feature (165)..(165): n is a, c, g, or t
  misc_feature (174)..(174): n is a, c, g, or t
  misc_feature (190)..(190): n is a, c, g, or t
  misc_feature (542)..(543): n is a, c, g, or t
  misc_feature (606)..(612): n is a, c, g, or t
  misc_feature (616)..(620): n is a, c, g, or t
  misc_feature (632)..(633): n is a, c, g, or t
  misc_feature (635)..(642): n is a, c, g, or t
  misc_feature (644)..(645): n is a, c, g, or t
  unsure (1)..(650): unsure at all n locations
nnannnggctgtgcatgggttcctggcgtgacgtccagtgtggcagcggcttgccgtcttcaggctacgacacgtggcttcctggcgcggcgtcaagcacagcaagcagcggcttgccctcttcaggttgcggcacttggcttcctgacgtggcgtcaagcacgncaagcggcnacacggttgcaggctncggtccgccgttccctggtgcagcgacttgcatcggtattgcgcgttgaacaacacgcggcacgtggggcgacaaggccttcagcagggttggccgatccttagccatgtggacagcaagaacaagtctggttgggtggcgctgtctccactggaactcgcggtagctcaggccgtaagactggtgagctgccacgtcttggcctttgcagcctggaagaggttgttcccatgggatccagggtggcatatgttaggttctttattttatttgttaataaattaaagcggagatgtaaaaggcttatagttagggttgcactttcacatgcatatcaagttagacagcaagnntgtttccatgcaccgagaacgagctgtcttcaaagggtgggggaatgtcatgtggtggcagcnnnnnnnatgnnnnnccatagggatanncnnnnnnnnannattag

SEQ ID NO: 673 - DNA, 709 bp, Zea mays
  misc_feature (5)..(5): n is a, c, g, or t
  misc_feature (7)..(7): n is a, c, g, or t
  misc_feature (184)..(184): n is a, c, g, or t
  misc_feature (290)..(290): n is a, c, g, or t
  misc_feature (357)..(357): n is a, c, g, or t
  misc_feature (450)..(450): n is a, c, g, or t
  misc_feature (609)..(618): n is a, c, g, or t
  misc_feature (622)..(630): n is a, c, g, or t
  misc_feature (632)..(659): n is a, c, g, or t
  misc_feature (663)..(663): n is a, c, g, or t
  misc_feature (670)..(671): n is a, c, g, or t
  misc_feature (676)..(683): n is a, c, g, or t
  misc_feature (685)..(707): n is a, c, g, or t
  unsure (1)..(709): unsure at all n locations
aaagnangaacattgaccagatttaaccttgaagttgcagacatcagaatagactgacagcttctcgggatatgtgggatgagagctttcaagtcaacttcgcagcggtaggatagaagtaggtcagcctggcaactaaagattggtatattagtaacttcttcaaaaaggaacttgcgtgatnaacattgtaattaatacacaataggtgtggattctgatgtacatcacttcaaaaaatgttgtactccctccctcaaccttctaaggcatattttgatgcaaaaaangttgtaattttgaccaactgttgtcaaattaaatgtatgttttgaagtcatattaatacattcatanttttgaagtgttttgtagtaattgaaaatatactgtgaaaagaattcaaaggttcaaatatgattttgaaaactttacataccaaagtatacnctacaataataaacagaaggctcatatggcaatgcagctttaaataaagtgtcaccagatatgtaaagtatgatctccaagtctttaaaatggtacaaatcaaattgttttcgagtcaagagtcaagtcatgcaactactgactagacgaccagtcgtnnnnnnnnnnatannnnnnnnngnnnnnnnnnnnnnnnnnnnnnnnnnnnngctnatactannaacannnnnnnncnnnnnnnnnnnnnnnnnnnnnnnat

SEQ ID NO: 674 - DNA, 716 bp, Zea mays
  misc_feature (240)..(240): n is a, c, g, or t
  misc_feature (337)..(337): n is a, c, g, or t
  misc_feature (405)..(405): n is a, c, g, or t
  misc_feature (611)..(611): n is a, c, g, or t
  misc_feature (657)..(663): n is a, c, g, or t
  misc_feature (670)..(670): n is a, c, g, or t
  misc_feature (688)..(688): n is a, c, g, or t
  misc_feature (691)..(692): n is a, c, g, or t
  misc_feature (694)..(698): n is a, c, g, or t
  misc_feature (704)..(705): n is a, c, g, or t
  misc_feature (709)..(713): n is a, c, g, or t
  misc_feature (715)..(715): n is a, c, g, or t
  unsure (1)..(716): unsure at all n locations
gtatcttctcaattacttctcttgtttgtgtatttgttgtgcttcctgttaattatcatgggaaagagatgaatcacaatcatattccggaagagtcactgaatgtttttactatagccaatatcgtcgaagaatctcgaaagtaagatctgcatcttcattccatttacctgataacccacttttggcctgtaccctgttgttataattttttaaagatggtaacattgtaagattatntaattatatgaaagattatgtcactgcatcaaatacaaagggtaaaagacttgacaagtgaccattggcaaatctttggaagaagagaaaaaaaaantcaatcatggtccttggtcttgggtgaagaatgaataatatttggcccagttattttgtttttccttntctaggccaaacaatattaactattcagcagtatgttgtattatgaggttccttactttcctttctcatgtaaaactttccttactttccttttattaaagctactaggaatcattatatgttgtatggctgaagtaaaacctaacacatctcccaaattggacgagtaactgaattgcaagttggaattatcatacatatcattntttaatactttcgtcatagcaagctaatgacatccctgtcgtttannnnnnngatatantatacgtttcatgcaatnacnncnnnnnaactanntttnnnnngnc

SEQ ID NO: 675 - DNA, 950 bp, Zea mays
cgtcactccctcccccagacgcgtctggggatagcaactcccatgactacaatgggattaactcctctgctccctgtttgtttccggatggttccaatggcgaggatatgttttaccttgagcaagaacctgggcacctgggcgaccatgaaggtgctgctccggtagcagatagcagattcggtgttattgtgcaggagcagggtgttattgtgcatgagcagggtgaggccgtgggtactctcccaaatgggaacaatggaattggcaatgagatgaatgtggagtgtaaaatggtggtgccgtgcagcaacgagcatcgaatggcgaatgctgtcctagatgtgtttgaggaatgcctgagggaggcaaagagtaatggggttatcaatggtggcaatgtggacgggagtggtgaggaaagcgagctctccaagcggtggagagcgcagaggatggatgagcttgatgtcttaagccggaggctgaggttgctggttgagtatgctgcggcggctgggcagtgaagcagagattttggtggttttggtgatgttcctgccacccttttccccttttgtatagaagctaggttcctgtgctatgctttggaatgtattcctcagctggacccttgcctttagaaagcctactatatttaactatgtacccttgagtttaataactcgagcagcataataatctataattttaacgctgttatttgcatgggttcctgctgtttgatatagatgatagccttgttaatgtagcttcaggctttcaaatttcctctttttcaattagaagctgttgtacttgtaacttgtaagctgtgagagagtaatattatgtttccttgttaaccgcttgtaatgcttctcttatagcttcactacaacgtctacattcagcctgcaatacccatgatttatttgcaagcgcttcct

SEQ ID NO: 676 - DNA, 499 bp, Zea mays
  misc_feature (48)..(48): n is a, c, g, or t
  misc_feature (52)..(52): n is a, c, g, or t
  misc_feature (109)..(109): n is a, c, g, or t
  misc_feature (362)..(362): n is a, c, g, or t
  misc_feature (384)..(384): n is a, c, g, or t
  misc_feature (475)..(475): n is a, c, g, or t
  unsure (1)..(499): unsure at all n locations
caaaagatgaggggagttttagaacataatagcacacaaaatggcacnaccntggtatgatagtattaagaaaaagtgtagaatgatcatacaaagaagtatcataaanattggttttgaggatactgtcatcatctacaatgaggatttacacatcaagatatcgcccatggattttaagttgacttgaaacagttttggttatgtacttcaccatctaagatttttgcatcatctatggacattaggtcgaaaattctctaaatactagacacggttgtacacatacttccaacacagatgaaacttggttcaaacctataaacatatactgtaaccttacaagaaaatataattgagtnaaagtgtgaagttcagtataanacctaacaatgctatgcaagaatgcttcagtattgaaattatataagatgacatggaaacagcttgtgttgttgatgaaaagttccaatgngtcaatttgttagggtgcatttca

SEQ ID NO: 677 - DNA, 645 bp, Zea mays
  misc_feature (303)..(303): n is a, c, g, or t
  misc_feature (346)..(346): n is a, c, g, or t
  misc_feature (414)..(414): n is a, c, g, or t
  misc_feature (475)..(475): n is a, c, g, or t
  misc_feature (483)..(483): n is a, c, g, or t
  misc_feature (531)..(531): n is a, c, g, or t
  misc_feature (549)..(549): n is a, c, g, or t
  misc_feature (559)..(561): n is a, c, g, or t
  misc_feature (564)..(568): n is a, c, g, or t
  misc_feature (571)..(571): n is a, c, g, or t
  misc_feature (584)..(591): n is a, c, g, or t
  misc_feature (595)..(596): n is a, c, g, or t
  misc_feature (605)..(609): n is a, c, g, or t
  misc_feature (614)..(623): n is a, c, g, or t
  misc_feature (625)..(644): n is a, c, g, or t
  unsure (1)..(645): unsure at all n locations
cagctcctcaacgccgatttcggcggccgcaagatcatccgccgcgccgaaatcgaggcacgcgagctccagcgcatccgcgaggtcgagcgccagctcctcctccaaaagcagcacaggcattcccgcccgctgtcctccccctccagttcctcctcaagctcctcgcccacctccgcagccgctgacgccgacgccgacgcgtcgcgggcagagagcggctccaaggagtcgctcccgagggaggaggtcatccggcgcctgcgcgtgctgcggcagccggccacgctcttcggcgaggangacatcgcgcgcctccgccgcctccaggtcctgatcgaggacnccggcgcgctcgccgacatcgacgcggcggagatcggggagggccagaccaacgacttcctccgcganatccaggcgatgcgtgctaaagctgcgactgtcacgaagcccaaggcggccggcgcggagnccgagcgnggggagggcgacagcgtatcgatagatgtgccgttcgaggagctctgngacgaggacaagatcacngcgttcttcnnnagnnnnntgnacgagtggacccnnnnnnnngacnntatgcctgnnnnngaacnnnnnnnnnnannnnnnnnnnnnnnnnnnnnc

SEQ ID NO: 678 - DNA, 675 bp, Zea mays
tattcgagctcggtacccctgctacactactattccctggcaaacgcattacagccgcagtactgctcctttggagcttccctgtcttgatcgggtggcgtcactcgttccatacttccatgggctgctagctgaacgctagccgacgatcacgactagacctggtggtgctcctgatctgtactgtacttcttttttgagcgaaccaacaaagcggcgagaagctctccaaaataaagccgctcgacgtacgcgacagcaacgtgtgccccctcgccgcacatctgcgtccaccaccgcatagcatcatcagtcggcatcatcattggatcgaactccaaagctagcactgcaggatgtacacatatatatataaacatcgtgagggagttggttgcatgcagtcgtcttgcttgcaggtagcgaggatcacacacacacacacacacttccttcagtgcgcgcactactacctgtcagtgagtcactcagtcagtcagtcagtcactcactcgcttcctcttcagttcgttcctctcgagaaccatatcccttttaattcgcatattctccctgcgtcgaacagcgcctttgcatgcgtctccgatcccttccacaccggctgcgccgccatctccggcgctagcgctactacggagagagatagcatcagct

SEQ ID NO: 679 - DNA, 642 bp, Zea mays
gtcatctgcctcggctcgccgccgcacatgatgggctggttgaagccgccgttgaacgccacgccgaacacgtcgttcggggccatcttgctcgccgccgggttgtagaacagggtcagcccctcgccctgccaataacaactccatcccatcccattcgcgcatcagattcagtgttgacacacaacacaagcaaggcccgaaccccgagtcccatcccatccaaaacaacaactcgagtccacaacagtactcaccggggaggacggcaggccgttgctggtcttccagtacaccggcgcccgcccgagctcgaactccgcccacgtcggcagcgacaccgacaccctgcttggagtttggaggtcgatcagaagccgtgcgttcacgtccagcagcagactcgtcgtcagccaacaaagctacaagagcagcgagcgatggcatgcagcagacagcttgtttttgttacgccacttaccccgtgttctgctgctctacggcggccggcgccgcagtggcagcggcggcggccgtgcgaatgctcgcggaggagctccgccggctggcgacgaggactcctgcacgggtcggcttcggctgccggcggatagccgcggcgccggtgccgctactcaggcg

SEQ ID NO: 680 - DNA, 716 bp, Zea mays
  misc_feature (80)..(83): n is a, c, g, or t
  misc_feature (115)..(115): n is a, c, g, or t
  misc_feature (135)..(135): n is a, c, g, or t
  misc_feature (193)..(193): n is a, c, g, or t
  misc_feature (274)..(274): n is a, c, g, or t
  misc_feature (403)..(403): n is a, c, g, or t
  misc_feature (479)..(481): n is a, c, g, or t
  misc_feature (504)..(504): n is a, c, g, or t
  misc_feature (531)..(531): n is a, c, g, or t
  misc_feature (571)..(571): n is a, c, g, or t
  misc_feature (591)..(593): n is a, c, g, or t
  misc_feature (595)..(595): n is a, c, g, or t
  misc_feature (609)..(610): n is a, c, g, or t
  misc_feature (612)..(621): n is a, c, g, or t
  misc_feature (628)..(629): n is a, c, g, or t
  misc_feature (650)..(651): n is a, c, g, or t
  misc_feature (656)..(658): n is a, c, g, or t
  misc_feature (665)..(667): n is a, c, g, or t
  misc_feature (669)..(674): n is a, c, g, or t
  misc_feature (678)..(683): n is a, c, g, or t
  misc_feature (685)..(685): n is a, c, g, or t
  misc_feature (687)..(689): n is a, c, g, or t
  misc_feature (691)..(693): n is a, c, g, or t
  misc_feature (696)..(696): n is a, c, g, or t
  misc_feature (699)..(703): n is a, c, g, or t
  misc_feature (705)..(705): n is a, c, g, or t
  misc_feature (708)..(715): n is a, c, g, or t
  unsure (1)..(716): unsure at all n locations
agaagcttctctaaccttaaaactatcaaaaagaaagacaaaaaaaacaaaagagactccaaacactgtgctgtccatgnnnntttcggattctgtccaaatcttactttcaccnaagctgagcacatttattcntactaccgctggcaagtaagtgaaacgccgattaaaactagatggtgacaccgcgatnaagatcagaaattgtttagcttttgaagaagccggtgggcggtggcacgtagcaagtgaaaacaaatggagattttggaancacgaacgaaaaggttcacgctaatctgccagttcacacagtaatcatgagcatatttgttctcttccccccgcaaagcaacaaatcgaactccctactcccgagtgcatccaaaaataaagggaagangcgagagaaaatgcttcacacacggcatgcactactcacctccgccaccatgccactccagggcagcgccgccgcnnntggccgggaccagcgccggcggntcgaccttgatgacgtcatgcagctcncgcagcatcttctcgaggctcgccgcgttctgatgatccngcagcgctgcgccaccaccnnnangtgcggtggcggcnncnnnnnnnnnnggcgtcnnttgggcgtattggtttgaagnnagctnnnccactcnnngnnnnnnggannnnnngngnnncnnnagnctnnnnngntcnnnnnnnnc

SEQ ID NO: 681 - DNA, 582 bp, Zea mays
ttatgaatggcagattgatttctgtctgagaagtcgacgaaagttcaacctttgccttctcagcagcttcacgaagcctttgcagggccaatctatctttcgacagatctatgccctcagttttcttgaaatcactcaccaagaactccaatagtgtattatcaaaatcttcaccacccaagaaagtatcaccatttgttgctttgacctgagtagcaatacatagaatcaaatcagaacagtgtgtaattcagaagatgtttccacaatgaaaaaaagagtgattcagaaaacgtttccacgatgagttcacttgaaggttatggagagatacctcaaaaactccatttgagatctccagaatagagatatcaaaagttcctcctccaagatcaaataccgctatcaagccttccttgttgttcattccataagacagagcggctgctgtaggttcattgatgatcctttcaacatcaaggccagcaatgcggcctgcatcctttgtggcctgacgctgagcatcattgaaataagctggaacagtaatcactgcctttgagatagacttgccaaggtaag

SEQ ID NO: 682 - DNA, 719 bp, Zea mays
  misc_feature (526)..(527): n is a, c, g, or t
  misc_feature (554)..(555): n is a, c, g, or t
  misc_feature (573)..(574): n is a, c, g, or t
  misc_feature (592)..(593): n is a, c, g, or t
  misc_feature (600)..(604): n is a, c, g, or t
  misc_feature (629)..(632): n is a, c, g, or t
  misc_feature (634)..(634): n is a, c, g, or t
  misc_feature (636)..(642): n is a, c, g, or t
  misc_feature (646)..(648): n is a, c, g, or t
  misc_feature (652)..(653): n is a, c, g, or t
  misc_feature (657)..(660): n is a, c, g, or t
  misc_feature (664)..(718): n is a, c, g, or t
  unsure (1)..(719): unsure at all n locations
ttctgtaccaccaggaacacctcatcccatttatacctcacagggagttgcttgaagaaattattcccaacagcagagatttggagtgggcggtaagtgattgtgagaactcatggaataaaatgagatgtagctttgcactggtttattatgactaatgagagttacatgtcctgccgttaacttcaattttgtcatgactagaatctcaccagaatagttctcttgctccagaaaccataggagtttgaatctaaagtaatggatttcgatatataagtacatctaaatcttgtatgatgctgttttctatgaacctataattaccttttgaaaatattgacttaataattatttacaacacttattattctgtcgccagtttgtggatattatttgacttggtggtgatattgttgtttcacatttaactgatttacattttacctttaggttcctactgtgtcatatccacgattggtgaaacttcttcaggttagctattatagcaagtctgtgctctcanngctcgtgatttctacaggtggattgcnngagtctttgaagaaagcnncaatgtcagctttggtanngtatctnnnnnattcagacatcaatactaattgtgnnnngnannnnnnngagnnnctanngagnnnngatnnnnnnnnnnnnnnnnnnnnnnnnnnnnnnnnnnnnnnnnnnnnnnnnnnnnnnnt

SEQ ID NO: 683 - DNA, 483 bp, Zea mays
  misc_feature (7)..(10): n is a, c, g, or t
  misc_feature (136)..(136): n is a, c, g, or t
  misc_feature (168)..(168): n is a, c, g, or t
  misc_feature (376)..(380): n is a, c, g, or t
  misc_feature (406)..(406): n is a, c, g, or t
  misc_feature (413)..(413): n is a, c, g, or t
  unsure (1)..(483): unsure at all n locations
caccgannnnctgaggttcctgtcgtcgaagcaggccctgttcgacctggccgtcttccggcagtactatcaggtttaattaattaattggcattgtgttgcctgattcagcaactcgtgcttcatgtgctggaanaatcgtgagcctttctctgtttttcctttttncttttcccggtaggaatcgctgaatgcccggtacaaccgatcaggtttcgacaacccctggttcgtcatcggggtctcctactccggcgctctcagcgcctggttcaggctcaagttcccccatttgacatgtgggagcctcgcgagctcaggggtggttcttgcagtgtacaactacaccgactttgacaagcaggttgatagtccnnnnngggcataggtggagacggcgcaaatnaattctntctgtttgatgtacttctacccaattcaggtctccatatgtgacagcctttattatgtaggttggagagt

SEQ ID NO: 684 - DNA, 1073 bp, Zea mays
agttgaaccttcttttaaggaaccagattccgcattcttgaggatctcacacacctctggcggaagttgccagctgctaacctgtaagcaactcagcgagcaataagacatacataaactcatgagataccaaaataccaatgcaaccccattagtgtatatgttggatgttgctaagctattaagccatggtctagaccttaccttttgtttgttatcataataatatttctttccatcacttgtagttactatgctccagttagtaccagccaatttatccctagaagagattcagattccatgtcgcattaaatttgtgaacatgaacaaatatagaagacaagctaggatgcattcatcagataaaaagaacaattaaaaggggatactgaatctagtggctagtgcatactttagctagtaattttgcaatcaaattgttatacgctctatcatacaatagcatttaatatcttcattatgatttgataagcaaattggatctttctgtgtcaagagttttcattatgtctaactaaacagaataaattgaacatgcaatgcagtggaatatacaatactaaatgttagcagcatgctcagattaaaaaacaccagggattcatgtaactcagcaaaagtcaggtcttcatcacaccattttaaagcacaacaaaaataatgtggctaagcagaatggcagggcagcataactaaagctatttcttgtgtaggtgcataagaattcagagactccgacagccctcgctttgattagtgatcaggttcctatcataattcatagctggcgaactgctatctaaaatgaatccttgttttagagacttccagttcgtgtaaccaaatgtcttcataactttccaaggcaataagaattcagaaatcatggtatcattcacaataaattggttgcgccttcgagaactccaaagagaataaagtgggacaaattaacttcaacaaaatacttgcaaatttagagtagacaaacatagttcagtataaacatgagaccagacataccaagaaactggaactggttctgttgc

SEQ ID NO: 685 - DNA, 532 bp, Zea mays
  misc_feature (209)..(209): n is a, c, g, or t
  misc_feature (261)..(261): n is a, c, g, or t
  misc_feature (275)..(275): n is a, c, g, or t
  misc_feature (402)..(402): n is a, c, g, or t
  misc_feature (434)..(434): n is a, c, g, or t
  unsure (1)..(532): unsure at all n locations
gacgtcaactgttctccatcaactggaagggaaatccagcaaaggtcccttttaatgttattgcagaccattccattgaaatgtataaatccagctttcttgtttgttttatagcatattttaccatatttatgtgaatggcggggcaggcccctacatgtatttctagcaatcaagcagtttcctaattttgcatctatgtttttttnatcattttaactaattttattcccatttatatcttgcttatacaacatccanttttcttttctagnactagaatagattgatgtgaaggggaaagaatagaaggagaagcttaacttgtatattaagaggaaagatagaacagtgtacaacagagcatcaactgatttgtggaacaattttgtcttcattgtnatcttcttcgtcattgcataatctgtagatgntgtaagcgtagttaaactttattccatgcccaagttgttgcttatgtcgttaagttcttgagaaactcaactgattagattgaaattatgcggattgt

SEQ ID NO: 686 - DNA, 763 bp, Zea mays
cgtcgtctccctggtattcctgcaagcaacaaggtcagtatacatacatgaaaaacctgaagccaattccatacaaagcgaggtcaatttctctaactccaatgttacaccggacgaatactcaacaagcaaaccaaaaaaaatgtcagaaaacgtaatgcaaaaccattagtaagtatgcacatcatcatcgtttgtggtcctacgaatctaccattcctctcgatgtctagcttcaggtgccataaaaaggctagcggacaaccaagcatccagccagaggaaacaacaaaatggttaggactatagaactccaactcgcagtcccatgaccatgagtaggtaaggctcactcgccaagccttcactctcgcctgagacgacaccaaaggcaggcgaatccccagaaccgaaccgaaactgcatgaggcaggccgggcaccaaacagtggccctagcaaaacatgcacctggcttcgctatgctcgtaggtggccactgatgcagcatgatttacacaaacacacacactgttcagatcatagcagtgcacgcttccaccctccagttactgtttaggctgccatacatgaagggcccaaagggattagagactcagctttacaactgttccgtattatggtccctcctttaggcggtgctagcatcaaggccatggctagagccgcaaacagcacgccacggcttggccccgatggtgaaccaaaaacgacaaaagaaatggcacagcaaccgctttcgt

SEQ ID NO: 687 - DNA, 790 bp, Zea mays
  misc_feature (747)..(755): n is a, c, g, or t
  unsure (1)..(790): unsure at all n locations
attggctgccaaactcaaggttctggagtttgactcgttgacattatcctttcgaaaggatttggacatatgattcgtcaactgcatcatccagaaatgctactatatactgtgggtctgaagtcagtgcactttcatgggaatgcagatctgacagattggtatgcctatattggatttgatggcactactatctttccattactctaaatttggttaaactaaacttgttgaagatttctgttttgtcacccatttctcttgaccatagctgctcataggcacagctaatggaggaattaaagcttggaatgctgatgcaaagagagttgtttgcgacctgagtacatctagaaactttccaaggttataatctatagtctgcttgttccttgctgagaatgttttgttaacaaagtttttctatttcttgcagcatcttagatttgaaatgcagccctgttgaacctgtgtttgtctctgcagctgcatcaagacggtattgtctagatttcatacttcatgtgcatgataagaagtccatagctttgttaactccacatacttttctctctagtagcatcgttttattatacttagtttgaacttatacatcttttcaggcatggatcaactacatttgagagaacaggatttgccaacttgacagtgtggcatatgaaaacatggaagccattggtagttcatttgctttcatcctctcttgaacttgtatgtggatttgtnnnnnnnnncttttctaaaggcttccccccctttttttcttcta

SEQ ID NO: 688 - DNA, 713 bp, Zea mays
  misc_feature (385)..(385): n is a, c, g, or t
  misc_feature (592)..(592): n is a, c, g, or t
  misc_feature (616)..(617): n is a, c, g, or t
  misc_feature (629)..(630): n is a, c, g, or t
  misc_feature (633)..(635): n is a, c, g, or t
  misc_feature (641)..(644): n is a, c, g, or t
  misc_feature (649)..(649): n is a, c, g, or t
  misc_feature (653)..(656): n is a, c, g, or t
  misc_feature (659)..(660): n is a, c, g, or t
  misc_feature (685)..(685): n is a, c, g, or t
  misc_feature (690)..(696): n is a, c, g, or t
  misc_feature (700)..(712): n is a, c, g, or t
  unsure (1)..(713): unsure at all n locations
cacaagtcaatgatggttatcaggaacaatattgtcgtggggggcattacttatcgcccttatgcaaggtaatgctgccactttagttacaatttgttatgttgacattgtatatttgttgtgcttaatggccaattcaatatattctatatgtgctctttctgtgtgaggatccaatatttttttgcaactgaaagcaaatgtctcccaactgacaccactcacttatgagaaaatgttggccaatcaagatattgcgtcgtaactttgtacttattcaggaaatctattattttgatgataattaaaagctggcaagttagaatgtaggttgcaaacatttgcatgcttttgtttatcctgcaatatctctctattatgctantttttcttttggaaatcatagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcaggtatggctgcctgaccntttaccttatataatctatttctnncaatttcttgtnngcnnntatcannnnctganagannnnggnnactacatgtgtgatatacttagtanacctnnnnnnnacannnnnnnnnnnnnt

SEQ ID NO: 689 - DNA, 726 bp, Zea mays
  misc_feature (39)..(39): n is a, c, g, or t
  misc_feature (41)..(42): n is a, c, g, or t
  misc_feature (323)..(323): n is a, c, g, or t
  misc_feature (370)..(370): n is a, c, g, or t
  misc_feature (716)..(718): n is a, c, g, or t
  unsure (1)..(726): unsure at all n locations
accggcccgtggtttatattgcctctctggctcgcgtantnnccggtacacccattttctcctgcaaagattctttataaccattttgacggtggtgagcccgaagccagcgaaaaccatcaatcccattcctctcctccgctagtagccgccaaatcgacgagaaggagccgaggccaggcctccaccaagtatcagattccacgccctacgaatcatcgcaatggtgagtattcgcccgcggcggccccgtcgagctatgtgtggcttactgctcgcatagcctcttccgccgtgggcttggattgacggcccggttgttngctgaggtgaggtcctgctgtgtgtgtgttttgtgcagacgaagaancagcggagggaggcgggggcgatgcgacggcgagaccgacaccaccatcaccggcggcagccgcgggacgagcgctgcgtttcctgcaccacgtttaacatcctggcgccgatctacaagcgcatggacaacgaggtgggttggatcttgctctgctttcccttttgacggggaatctatttagttagttttggtttggtagaaaattctggctcgtagtatattgacggtcggtgtttggcattgggagcagaattgcagggagagccagtacagggcctactggttcagccgcaacgagaagattattgaccgccttctcgctgatcactcctccatcatctgnnntcaggggt

SEQ ID NO: 690 - DNA, 748 bp, Zea mays
  misc_feature (112)..(112): n is a, c, g, or t
  misc_feature (232)..(232): n is a, c, g, or t
  misc_feature (254)..(254): n is a, c, g, or t
  misc_feature (402)..(402): n is a, c, g, or t
  misc_feature (518)..(518): n is a, c, g, or t
  misc_feature (569)..(569): n is a, c, g, or t
  misc_feature (697)..(697): n is a, c, g, or t
  misc_feature (719)..(719): n is a, c, g, or t
  unsure (1)..(748): unsure at all n locations
tacccctgctgaggatctcatagttgcgatattgactgcattggactgtcttccgatcagcaatgagcaatcagtctcctgtggggttatgcctactgttggtcacctgctngctcacagaattgccgtgatcaaccaaaaggcaagagcactctgtcacaagtggggcggtgtaccaaaacatggtacaaatggagagcattttcatacagaggagtcaagccacactgancagcttaagtctccagatgccngccacaagacagaaactaagagaaagtgtgtagtggacgaaggagagcctgatgaagaatcaaaacctgaggtgacaactcactcagatgcacctttgtccgacccttctctgactaatgataatgcagatgcaacagagcaaccagnagggctaacttcaccaaatccatcaaacggaaatgcaacattaggggatgtgaacaacttggtcaggtctcctacatctgcaggtcatgtgggtttagaagatgggcagtccaccnccaatgaaatttcttccaatgatgctgaactgcccattaatggcatactcnggtcaaactctactaatgcaaaaagtggtactggacaagatgctccagtggaatcaactccagtggccatgtctgtagaccataataaacctggaaagttgtttcctggtagtaaaatgggtctggangatagtattatttcagttagcncaagtatcaaggagtctcagccatttgca

SEQ ID NO: 691 - DNA, 688 bp, Zea mays
gttatctaatctagatcagaagctgaacgctgctgcggaagttgcatgctggagatgtcctcacggggcaaatggcccagcgagcattctgctccggcatcagcactgctacccgatactgcaagctcagcatcgctctccagcaatggctgggtggacttcctgttcctcctaaagacgaggtataggatcgcaactatgtaaatcagcatgcccaaaaacccgaaaataccggaaaatacttgagaaatggtggtcagcccgctctggacgagcaatttcacaaagcttgttatcagaaagtaggtgttgatgacaacaataaacgagccgatcatccatgtcagcacagcagtctgcatttgacaatcaagttagatgagttgctatgcaaattcaaggtaattactgtcgattctgtgacaaaatgactcacgaatattgaatttgtatgctgccccatctttgttttgctgctggtgaatttaaggagtggaactaaagcaaaagggagttcaaatgacagtatcatctgcatgtagccgagcaaggcattagttaacatatacggagctaaaaaccttaattgacatgagtaatgagattaaacattatagaactattaagtttttgaggtatagaagagtacaacagtaaagttcactgattaccgatgcaatgataatca

SEQ ID NO: 692 - DNA, 679 bp, Zea mays
  misc_feature (103)..(105): n is a, c, g, or t
  misc_feature (567)..(569): n is a, c, g, or t
  misc_feature (573)..(575): n is a, c, g, or t
  misc_feature (584)..(586): n is a, c, g, or t
  misc_feature (608)..(620): n is a, c, g, or t
  misc_feature (641)..(646): n is a, c, g, or t
  misc_feature (649)..(651): n is a, c, g, or t
  misc_feature (653)..(653): n is a, c, g, or t
  misc_feature (656)..(656): n is a, c, g, or t
  misc_feature (658)..(664): n is a, c, g, or t
  misc_feature (667)..(676): n is a, c, g, or t
  misc_feature (678)..(678): n is a, c, g, or t
  unsure (1)..(679): unsure at all n locations
tgctgttgaatgtgtctggtttgtatctctaatttctgatttcatgaattggtttacatgtcttacgaacctaacaccctttcactggtttgccattatgttnnnattgatatagcacatgtgtctttcatataatctttgctgaacattgctcttgaccaacatggttaacaggtctgacggggaaatggtattcgtggacgataagcagttgaaagctaaggagcccctggtggtatgacctcattgttttctcatttcacataatgaagtaaaaatggaatgacgccacaacaattattattctggtttgcagcttattgattactatgagcaacaccttcgctacaaccccacctcgtgataaggatgcattgacgctgctgggtttcagttgcatgtgctgcacctatgtttggaacaaatggaaatgtatttaaatgtagcattttttgtgctagatgcatttgtagtattatttgagtaagtagataattagtaagtagccaatgctgagtgcaagtgaaacatgatagcatggtttgtcaaactaactgctcgatattnnnactnnnttcaaattnnnttattaatcgtgataatcatgnnnnnnnnnnnnngtcgatttggaccaatagtgnnnnnncgnnnangtnannnnnnnaannnnnnnnnntna

SEQ ID NO: 693 - DNA, 1076 bp, Zea mays
  misc_feature (6)..(10): n is a, c, g, or t
  misc_feature (20)..(25): n is a, c, g, or t
  misc_feature (479)..(479): n is a, c, g, or t
  misc_feature (590)..(596): n is a, c, g, or t
  misc_feature (598)..(599): n is a, c, g, or t
  misc_feature (614)..(615): n is a, c, g, or t
  misc_feature (617)..(620): n is a, c, g, or t
  misc_feature (624)..(627): n is a, c, g, or t
  misc_feature (630)..(630): n is a, c, g, or t
  misc_feature (632)..(638): n is a, c, g, or t
  misc_feature (655)..(657): n is a, c, g, or t
  misc_feature (916)..(916): n is a, c, g, or t
  misc_feature (922)..(922): n is a, c, g, or t
  misc_feature (1049)..(1052): n is a, c, g, or t
  misc_feature (1064)..(1069): n is a, c, g, or t
  unsure (1)..(1076): unsure at all n locations
tccgannnnnaaatgcaagnnnnnngtataaggcagtattctttacatctatggttctttctgattatccactaaattacatttcttctaaagtgattaaatacttagctgttataaacatgcattcaggtgtaccatccaaatattgatttggaaggcaatgtctgtctgaacattctgcgtgaagattggaagcctgttctcaacatcaacaccgttatttatggcctgaatcttctttttacggtatttcagctatcttgtttccccaattgttgaaataatacatttagaaattgggaagatgaaagaatagtgtttgcatttttgcatgcattgttgtcatccgattacttcatttcatggactatgctgttcgagagttgctgtttaaagagtaaccactattgtgctcgcaaggatgttacctccaaaatagacataccaatctgagcaagacctaataggttctgttactngtaaaactgaatttcatccttaaaagattctcatgaaagatgagttgaagggtgcttctaactatgttaatgaatatttttgctcttaggtcttgattggatagcgtagtnnnnnnnanncatgaaattggtagnntnnnntttnnnnacncnnnnnnntgcaaaaccatggtttnnnaaaaaaatgtctagagtggattttttttttgaaatccaaataggctacagatttagctatactatggttttcaaaactgcaaagtttgttgcatcccatgttttattatcattgaccagtctactgttttgtccacgtgtataagcaaaactacttggaacttgcattcgtgacagtttaaattgtaagtttggttctgaaccttgttttcgaggacagcatatttaatactatggtttggttggaaaagcatctaaanaaaatnaaccttatctaatgtttatccttctttgtgaattatcgaatgtttacatacattgttacctgcagcaaccaaacgacgaggatcctttgaaccacgaagctgcagctgtcctccgtggcaacccaannnngtttgaggcaannnnnnaagagcc

SEQ ID NO: 694 - DNA, 490 bp, Zea mays
  misc_feature (92)..(92): n is a, c, g, or t
  misc_feature (205)..(206): n is a, c, g, or t
  misc_feature (303)..(303): n is a, c, g, or t
  misc_feature (434)..(439): n is a, c, g, or t
  unsure (1)..(490): unsure at all n locations
tcgaagcatctattccattatgaaggccatgcaagtctttactagcattgagcaattgatcaccagatggtgtgccatttattataccacgngaacttccattgtgcattataccatctggcattgcagatccaggagcagtctctggcaaaaagcatgaattttgcttcactgaaacaagtaaagaaagtggtcatgttaaatnnctgaaacttgaaagcggcaataagatctcatggacaaaaacaaaacttcaaacgaatgaatggcagacttgtctagctcatacaatggttaaatcantttgcaaagtaaacatgtatgcctgagattccatcatattgttacaggacttcactcggcaaatcagaaaattcagttaaataatgatgaacaatccctgataagaatgttggaaacaaatgtcttacatnnnnnngagttagagccattaggaagcgacatagaagggatccctgaagaaaattct

SEQ ID NO: 695 - DNA, 881 bp, Zea mays
  misc_feature (33)..(33): n is a, c, g, or t
  misc_feature (43)..(43): n is a, c, g, or t
  misc_feature (185)..(185): n is a, c, g, or t
  misc_feature (263)..(263): n is a, c, g, or t
  misc_feature (308)..(308): n is a, c, g, or t
  misc_feature (318)..(319): n is a, c, g, or t
  misc_feature (420)..(420): n is a, c, g, or t
  misc_feature (460)..(460): n is a, c, g, or t
  misc_feature (512)..(512): n is a, c, g, or t
  misc_feature (525)..(525): n is a, c, g, or t
  misc_feature (572)..(572): n is a, c, g, or t
  misc_feature (578)..(578): n is a, c, g, or t
  misc_feature (609)..(609): n is a, c, g, or t
  misc_feature (670)..(670): n is a, c, g, or t
  misc_feature (839)..(840): n is a, c, g, or t
  unsure (1)..(881): unsure at all n locations
gggcataccagaagaccaacccataaactaccncaatataagncgagaagagtagaaaaaagaaacagctagatcaaaaggtcctcaagctcttcatcagtgcaggtttgactgcccatgagcgtatgtacaaatggttggtgcgctgtgcatgaccccgctcaacctgctgaggaagaacaccngtaaataccagaatgcatgtttgtccaccagaagtcgccactacgacagaatgcaactcaaatcaagagaagattctnttggagactacatcggctaaatccttggcatatagagtgatctcnaccagtaccnnacccaagaaaacactaatacacatacccgaactacattgtttgtcgaataaatgcttttattactccggggacaatgcatgaagatcatagaatgcagtanatgctgtatttatggggtcgttgtgacaaacaaaaaaganggatgaatcacctgtatggtctccccctgtcgaatcggagaaatttgtttcnggggtgagaaatngtgttatctctgtaaaaaagaatccaagacaagacaaataacttatncagtanaggggagacaaaaaagaagacactcaaaatnaggaataaagaattcaacaaatatcactggaaggtacctgcactttggttgaaatcgtctnccaagtccggaaagatgaagctttggggcatttggttcaagaagctaaatgacgatgattccatatccagaattgaatcgtttagtggttgcccgttcagctctgagctactgaaggatccaccaccagatgcatcgcctattgactggcacgattccaggaaagtatnnccacagaaagcaaaatcagcattgctcgaatagcaagactc

SEQ ID NO: 696 - DNA, 806 bp, Zea mays
  misc_feature (180)..(180): n is a, c, g, or t
  misc_feature (211)..(211): n is a, c, g, or t
  misc_feature (217)..(217): n is a, c, g, or t
  misc_feature (264)..(264): n is a, c, g, or t
  misc_feature (277)..(277): n is a, c, g, or t
  misc_feature (329)..(329): n is a, c, g, or t
  misc_feature (369)..(369): n is a, c, g, or t
  misc_feature (403)..(403): n is a, c, g, or t
  misc_feature (470)..(473): n is a, c, g, or t
  misc_feature (481)..(481): n is a, c, g, or t
  misc_feature (526)..(526): n is a, c, g, or t
  misc_feature (604)..(604): n is a, c, g, or t
  misc_feature (746)..(746): n is a, c, g, or t
  misc_feature (756)..(756): n is a, c, g, or t
  unsure (1)..(806): unsure at all n locations
tccttcagtagctcagagctgaacgggcaaccactaaacgattcaattctggatatggaatcatcgtcatttagcttcttgaaccaaatgccccaaagcttcatctttccggacttggcagacgatttcaaccaaagtgcaggtaccttccagtgatatttgttgaattctttattcctnattttgagtgtcttcttttttgtctcccctntactgnataagttatttgtcttgtcttggattcttttttacagagataacacnatttctcaccccngaaacaaatttctccgattcgacagggggagaccatacaggtgattcatccntcttttttgtttgtcacaacgaccccataaatacagcatntactgcattctatgatcttcatgcattgtccccngagtaataaaagcatttattcgacaaacaatgtagttcgggtatgtgtattagtgttttcttgggtnnnntactggtngagatcactctatatgccaaggatttagccgatgtagtctccaanagaatcttctcttgatttgagttgcattctgtcgtagtggcgacttctggtggacaaacatgcattctggtatttacnggtgttcttcctcagcaggttgagcggggtcatgcacagcgcaccaaccatttgtacatacgctcatgggcagtcaaacctgcactgatgaagagcttgaggaccttttgatctagctgtttcttttttctactcttctcgncttatattgnggtagtttatgggttggtcttctggtatgccctgcgatggcgtcgttatc

SEQ ID NO: 697 - DNA, 694 bp, Zea mays
  misc_feature (135)..(165): n is a, c, g, or t
  misc_feature (330)..(330): n is a, c, g, or t
  misc_feature (344)..(344): n is a, c, g, or t
  misc_feature (459)..(466): n is a, c, g, or t
  misc_feature (474)..(475): n is a, c, g, or t
  misc_feature (484)..(485): n is a, c, g, or t
  misc_feature (496)..(496): n is a, c, g, or t
  misc_feature (519)..(519): n is a, c, g, or t
  misc_feature (555)..(556): n is a, c, g, or t
  misc_feature (567)..(567): n is a, c, g, or t
  misc_feature (570)..(570): n is a, c, g, or t
  misc_feature (572)..(574): n is a, c, g, or t
  misc_feature (582)..(586): n is a, c, g, or t
  misc_feature (591)..(591): n is a, c, g, or t
  misc_feature (593)..(595): n is a, c, g, or t
  misc_feature (600)..(605): n is a, c, g, or t
  misc_feature (607)..(644): n is a, c, g, or t
  misc_feature (649)..(693): n is a, c, g, or t
  unsure (1)..(694): unsure at all n locations
ctagctacagtgtgcaacagtgcggtgtgcgtgcgtgcgtccgcgcgcgcgcgccgtttcagtttcctcccatggcgtccgccgacgactgtccgaggacgcgtggtcctcgacgacgacgaggaggagggccannnnnnnnnnnnnnnnnnnnnnnnnnnnnnntgcacctttcgcggccggaaaggaaagcggtgctgtggtgttgtagtagtagctagtagtgttactacccgacacactccccggattctccgccacgtggcgaggcatgcgccgtccgctggagcctagacggtcgggatggccccacggctatacaccgtaccngtacccttgggggnttttaaactcgcccggctacgcccaccacaacttctcgaccggctgaatgaacctgagcgcccgttccgttttcactctactcttctcccgctcctctccttcctccctttcttnnnnnnnnggcctgcnnaaaaaaaanngcttcccggcnggtggtacggtgaacattcttcncaacagtttttgggagtgcgtacgtgcaacacttcnngtctgatgcgngtngnnnggggggannnnngctcnannngctgnnnnnngnnnnnnnnnnnnnnnnnnnnnnnnnnnnnnnnnnnnnntagcnnnnnnnnnnnnnnnnnnnnnnnnnnnnnnnnnnnnnnnnnnnnna

SEQ ID NO: 698 - DNA, 694 bp, Zea mays
  misc_feature (594)..(594): n is a, c, g, or t
  misc_feature (624)..(625): n is a, c, g, or t
  misc_feature (642)..(643): n is a, c, g, or t
  misc_feature (667)..(675): n is a, c, g, or t
  misc_feature (677)..(677): n is a, c, g, or t
  misc_feature (679)..(679): n is a, c, g, or t
  misc_feature (681)..(683): n is a, c, g, or t
  misc_feature (692)..(693): n is a, c, g, or t
  unsure (1)..(694): unsure at all n locations
tgcagcccccttgggccctgacaggtcttgacactacacccctcctggacaagcagctcgtcctcgagctgcaacataacgggtgcccaaagaccgactctacttgacccaaaaccaaacactgtagcttagcgggccctcttgggccctgacagttatgagctaatgaaatactaaaatctgtcttacattatgtttacttgcatcataatatctatgttcactaaaacaatcttgatttgctcttgctaattttctctctatcagatccatgcactgttcattgcaagatctattttgtttcagggcttcatctatcccaattctccgttgctaatgagatcctgctctttgcctctatttttcgtttttaggttggcaacctggaattcaagagacagcttatgcatgggatgaagaatgggataattttggagatgaaggtatgctagcttcaattttgattctaccaccatgaccattattcaatccgtgtttatgctgacaatttacatattaaactatatatgctgctccgcttgcatttatccaggattctctataataaaggaactaacagttgaagtggagccncccgttgtagcaaagagtcagcctactgannatgttaaagcatcttcnnatggggcatcaacagaaaaagaannnnnnnnngntnannnatctgctgnng

SEQ ID NO: 699 - DNA, 675 bp, Zea mays
  misc_feature (8)..(8): n is a, c, g, or t
  misc_feature (17)..(19): n is a, c, g, or t
  misc_feature (25)..(25): n is a, c, g, or t
  misc_feature (72)..(76): n is a, c, g, or t
  misc_feature (532)..(534): n is a, c, g, or t
  misc_feature (547)..(547): n is a, c, g, or t
  misc_feature (573)..(573): n is a, c, g, or t
  misc_feature (575)..(575): n is a, c, g, or t
  misc_feature (578)..(580): n is a, c, g, or t
  misc_feature (597)..(602): n is a, c, g, or t
  misc_feature (605)..(605): n is a, c, g, or t
  misc_feature (607)..(623): n is a, c, g, or t
  misc_feature (630)..(630): n is a, c, g, or t
  misc_feature (646)..(674): n is a, c, g, or t
  unsure (1)..(675): unsure at all n locations
tggttcangtcaaatcnnnaaactngttttgtgacaattggacaacgagtgcttgccaatccactgaggtannnnncttggttcatatttcattttacattcatgttgtggttatgcattatctattggttctagtatttcaatctttaggttgtgtgaatcgtcctcttatttgttttgttcttcggggtgttactatcctaagatgtttgcttcgtaatttttttcctgaaccttctttattcagggttcggtttcattatggccatcctgatgtcttcgatcgtcttttccacgttacgaggggcggtgtcagtaaagcatccaaaattatcaatcttagtgaggacatctttgcaggtacttttcttttgctgttactgctcaacatttgtaaatgtggaaccactaagataatattttggcttcttatggttcaggattcaattccacattgcgcgaaggcaatgttactcaccatgaatacatgcaagttggcaaaggaagggatgtaggtctcaatcaaatatcnnngtttgaggcaaanatagcaaatggcaatggcgaacaaangntgnnncgtgacatctaccggcnnnnnnatngnnnnnnnnnnnnnnnnntgctgtnttgttactacacaacnnnnnnnnnnnnnnnnnnnnnnnnnnnnnt

SEQ ID NO: 700 - DNA, 513 bp, Zea mays
tttgaagctttttgggaagacagttatcatcccagacccaaagaaagtctgttcctcggatgggggagctggagatgatacacaagaagtgatgcaaacatcctgggttggaggaggggtggcagcataccctgcccataacggatggtttcttccgttccattctttccctgctcatatgtatgagtcgggggatgctaggatttcccctcttcatatgtggtggccttactacggttttccggccggccatccaagagggtttggcacagggctgcttaacgaaggcaccattgagagtgatgccgacaatagcccatcggttgaaactaattctgatcgcacgggcaatgttcatgttcagacgacgacccctaccattcacaacaatgctgtcaaggagtcagttgggccagttgagatgccagagtcgggtcctagcgttgagctgaaacccagcgcgaactcggcctttgtaagagtgaagccgagcagcagcgtcagcggagacca

SEQ ID NO: 701 - DNA, 667 bp, Zea mays
  misc_feature (566)..(573): n is a, c, g, or t
  misc_feature (622)..(624): n is a, c, g, or t
  misc_feature (641)..(645): n is a, c, g, or t
  misc_feature (648)..(648): n is a, c, g, or t
  misc_feature (655)..(661): n is a, c, g, or t
  unsure (1)..(667): unsure at all n locations
tccacacgttcacgacctgtaccttgacacctttcccattctatctacgagtaaacagggcttcttatggatgctggagcaacccaaggatagcagcatcaatggcgctagcccagggatcagagacaggaagctcctcgtcgaggttttccctgtaaaaatgtctgctacgcttcaaggacactccctcaccttgtctggacccgatgatgcctcgcagctaaccattgacctgctcggttgcacagttgctgctgtttctgcatccaatctgccctcacgtaaatggttagtgcaaatcgtagctggcctcttcaacattcatctctctctacttattgttgttgttttcttgccatcagctacaaagcgtgacttactcggtgtatgcattattatgcttttagcagctatctggatccttgacttactacataatacaatacccagatttgatacactcctactatataagaaatcagagtcaaataactgtagcaggctcctaaagttgattatacagtttggctaaaactaccgtcagtacctgtttttttttcagggcnnnnnnnnatccgataaaactggaaagcaaggaatctggtatttgcagggggagcannntatgctatgtttatgcnnnnnccncttgggnnnnnnnatcatg

SEQ ID NO: 702 - DNA, 600 bp, Zea mays
  misc_feature (357)..(357): n is a, c, g, or t
  misc_feature (359)..(359): n is a, c, g, or t
  misc_feature (533)..(533): n is a, c, g, or t
  misc_feature (539)..(539): n is a, c, g, or t
  unsure (1)..(600): unsure at all n locations
ctcttcttcaccacgtccagctactccacgaggaagggcatcgagaacatgggcatcatggccatggcgtgcacgctgccgctcgtcctcgtgcacttcccgcagtggggttccatgctcctgccgcccagcgccgacgccgacgaggagcggtactatgcctccgagtggagcgaggacgagaagagcgtaggccgtcacagcgcaagcctaaagttcgccgagaacagccggtccgagcgtggcaagcgcaacgccgtcgccgtcctcgccacggccgcggccacgccggagcacgtcgtgtaacaactagcgtacgtacttgtaggttctgatcgagcatacagcaaactgtgnantgtactctagcagtctagcttgctccgatactcctgcttccaacaaaattatgaaacataggctaatatggatcggtgtacacgtacgtcgtagtatttcctgtgcaacatacacaattcagtaaatgaacaaactttgctcatgtgcattcttctgcaaagtacaaataaaantcaaanagagaggccaggacaacgtctatgatctatcaacttggttgttaaaattaaagaaaaccaa

SEQ ID NO: 703 - DNA, 492 bp, Zea mays
  misc_feature (215)..(215): n is a, c, g, or t
  unsure (1)..(492): unsure at all n locations
ttggaattgacatcagagaagacgattgaggaactttctcaatggtgaccttgcaatgctcgttcctgccaatgattgggtatgccaaatgatttccggtggctgtagaaggtgatgttgagcaagaaggaatttcctccgttagtacagattgtgtagcacctggagtcatcagttgggttccagctttggacaaaacgttggttgatgaaatntgtggatagacaacatctgacacatctgcaagcacaaattgtttctgtgaaggcttctgctgttcttgcttcattggtggtggcgcctgtgatgcttgcagcgaaacatcgctatcttgttgaggcaggatccgctgctgggcaagtgaatgagagcttgatagctgctgcatgtccaaaagtaacttctgttgttcctgtattacctgtaacggcgagagtgtaactgttggctgtgatacaagtgactgctgctgtagtttctgtaatagctgca

SEQ ID NO: 704 - DNA, 691 bp, Zea mays
  misc_feature (106)..(106): n is a, c, g, or t
  misc_feature (369)..(369): n is a, c, g, or t
  misc_feature (423)..(425): n is a, c, g, or t
  misc_feature (449)..(449): n is a, c, g, or t
  misc_feature (463)..(463): n is a, c, g, or t
  misc_feature (488)..(489): n is a, c, g, or t
  misc_feature (525)..(525): n is a, c, g, or t
  misc_feature (584)..(586): n is a, c, g, or t
  misc_feature (613)..(614): n is a, c, g, or t
  misc_feature (617)..(618): n is a, c, g, or t
  misc_feature (620)..(622): n is a, c, g, or t
  misc_feature (629)..(629): n is a, c, g, or t
  misc_feature (631)..(631): n is a, c, g, or t
  misc_feature (633)..(635): n is a, c, g, or t
  misc_feature (651)..(656): n is a, c, g, or t
  misc_feature (660)..(664): n is a, c, g, or t
  misc_feature (669)..(670): n is a, c, g, or t
  misc_feature (674)..(674): n is a, c, g, or t
  misc_feature (676)..(676): n is a, c, g, or t
  misc_feature (685)..(686): n is a, c, g, or t
  misc_feature (689)..(689): n is a, c, g, or t
  unsure (1)..(691): unsure at all n locations
aggagagaccggccatggcgaaaagacggagcagaatgctgaggtgacaactgatgtgacgaccttttgtgcaatggggaccgacagactcgtcgtcgtcgtcgtngctgcctcgccgtctctgcttctctctcctctgtctaggccccacgaggctgatatctgcgccgcatgcgggacccccgagccttatcagtgtctccataccccatgttgcactgcaccttgtatcacctgtcacctctctccctctccctcctttcttctcagcttgctggccatgagaccgctctcctcaacccaccatatttatctgcctcctctcgccacatgctctcctcctctgccggctcagtcgtgggacgagtnccgatcccgacccctagcttccgctcccgatccgtcgtctcatcctctcctacnnnctggtacgctctctcgccatgcgntgcgcctccactgnccaaatccgtcgaccgtctttgtgnncttgcaatcttgcatgcaagtttctaaaagctttcngtgatctcgctcttcttgcttcctcctcttgcatatcgtacactgggtctgcatgcatnnntgtcaccaccatattctatgcccagcnnacnncnnncactgtntncnnntctactcctgcgcatnnnnnntacnnnnncttcnntcgntngatcgatcnngcntt

SEQ ID NO: 705 - DNA, 530 bp, Zea mays
tgtcacttctaacaacaggctaccaaacagtgtggcatataatgcaaggcagacacgcaccatttcaacgtacgaccataaaaccagacccagtgttctgacagagcagcactagcacactgctacgtgtgcagttaattaacggagctgttgggggtctgactgcaaaggtgcatccaacatcgtgctggaaccggagatccaagcagcaaatctgacgtactagagctcttatgaagtatgaacagcacctgaattagcgtatcatatctgacgaaaaccaaaaggtactgttacctgtctctccgcttgtaaatgaaatgaatggtggttctggtattttgatctctgtttcttggagggcgtgatagctttgcagttaggcaaggcaatcaccgggggatgatccagtgcgttgttctaaccaaaagggcagtaaacccaaccactcgctagaggtacaagaagttcaggttgcctaggcgttctgtcgcaactgccaacagcaaagggatctgttggtgactgca

SEQ ID NO: 706 - DNA, 467 bp, Zea mays
  misc_feature (245)..(245): n is a, c, g, or t
  misc_feature (332)..(332): n is a, c, g, or t
  misc_feature (452)..(452): n is a, c, g, or t
  unsure (1)..(467): unsure at all n locations
ttctattgattgcagttttatattgtgatgttgtggaggcatatgagtaccatttttttttcttcttaatatagcactagtgttctgataggcgcaggaaatcaacagctcgtgcagatgggtttcttcgagcaccctctcttgtcgacaaccttgttatattttagaagttatttgtttgacatccatccatccatcttctctccaaatttaggtcggatgtacgagctctatcgacgttatanttgtgcctccgcgagtccgagctgacccagcagcgagtcaggtaccagcagtagagttgtttgttttgtcgtcccatactgaaaatntatcatctatgcacatctcttgcctgatccccctttcgccttctgtatcgtggttcagaatccagcagttgttgccaggaggatggttctgaagtcaccacgcctaaggatcaaaaggcntgtcgtagtggcaca

SEQ ID NO: 707 - DNA, 551 bp, Zea mays
gttccatgcacctgcgatctcaatgcacgaagatgcagttgaatccgatctatcgaaggcatttggaggacttaataggcttgacatgttcttcccatttgacccgtatctacttaaagagtctgacaggtttgactatcaataagagtacccattttagccagttatagtctcattatgttctagtgtgtgctcttggaggatagttatttgcatgttattcaataagggggtctgcaagtttcacctgacctttgaccttgtacacattggtgaaccacaatgtggtgggatttggatttctactcaggaacgacatcagttgaaggatctaaatggtcactttttagttgaaggacccaacatagaattcacggtagattgaggacctatatgttcccttcttttgttcaagaactcaaattagaatccataaaaaaaaataatgacccacagttcattttactcttctaaatttaattcttattgttgaatcgtctcttttatccttattgatgagttcaaccactattggcagaatagggctttaa

SEQ ID NO: 708 - DNA, 778 bp, Zea mays
agctcggcacccctggcaggctgggagacacacaccaccactacactaactaaacactacacaccagtaccatttggtcccggtttacaaaaaaaaaaagaagcaccgtcctaggttagcacttgcgctaatcatgcacttcaacgcatctcctttctcagaaagcaaacctatctgtttctaaaaattgaccagcagcacgtagtgactgagaaagatacttccgaattaaggcatgtgggagctgcgataggttatttctaacacatctccttggttgtttagtgtttttcttggttgataggaatctgcgttaagtgtgttcagccatgtaataacagaaactgaaacaaataaggtaacagctttcgtacgacaaagtcattgaaatatatagtgttgttctacaagctctggtgatggtgatgtatggcgatggccaccttaagttcatgagaatgcatatgctacagcctacagggcttaattactggctttaattagggcaatttggtttggtgtatagcttatgttctgacagatgagcaatgcatgcattgtcagatgaggaggaataattacattagtttgcagtaataaacctgtaactatttccgtaagggcttgtttgggtgctctagtattcaacccaatacacatggattgagagaaattatggtgtaaattaaacatagcctaaatgtatcatgtatgtggttgttttacccattaaccgcaatcagcaacggcgtatcttcttcagcatcactatgccgca

SEQ ID NO: 709 - DNA, 720 bp, Zea mays
  misc_feature (112)..(112): n is a, c, g, or t
  misc_feature (143)..(148): n is a, c, g, or t
  misc_feature (269)..(269): n is a, c, g, or t
  misc_feature (319)..(320): n is a, c, g, or t
  misc_feature (541)..(541): n is a, c, g, or t
  misc_feature (543)..(664): n is a, c, g, or t
  misc_feature (716)..(716): n is a, c, g, or t
  unsure (1)..(720): unsure at all n locations
aacattgcaacctgacctacctttgagaccatatataaagatcaccaaccagagagaggcaactgactcacaacacaatttgcagctacaaaaccattgtatatgtacggangtgctattccttgacgtcttcaaagagttcnnnnnngtcttcgtcctcgtcgttttctttggcttcatcagaatcgtagctgtcgtactgtaggaggctgccaaagtcgctggattgtgccttgatgagcctctcctggatcctctccttgatggcngtcccctgaggaagttttggaaacaagaatacataaatgagcagtggacnnctaatcgaaagcaatggactctctgcgaagggtggtcagagggtaactgaccattgagtggcacccttcctcaaacttctctaagaaaccagccacccagcggtctgcattttccacccactcttcctggagttttgcaaccgtgctccactgtaaacaaacatgagtaattcagaaggctaatggacaaaagggcaccaaccctgtctaaataaagtgangnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatggggttaaataaacacgatggtagatgcaaataccttctcccctacntttt

SEQ ID NO: 710 - DNA, 394 bp, Zea mays
  misc_feature (1)..(30): n is a, c, g, or t
  misc_feature (32)..(33): n is a, c, g, or t
  misc_feature (36)..(36): n is a, c, g, or t
  misc_feature (38)..(38): n is a, c, g, or t
  misc_feature (42)..(42): n is a, c, g, or t
  misc_feature (44)..(44): n is a, c, g, or t
  misc_feature (92)..(92): n is a, c, g, or t
  misc_feature (128)..(131): n is a, c, g, or t
  unsure (1)..(394): unsure at all n locations
nnnnnnnnnnnnnnnnnnnnnnnnnnnnnncnnaananctcncncgatttgtaaagaagttttcttgttcaatgaggcattgaatttgggangaatggcaagcctcatgaaaacttctgtatgccctnnnnacacgtgaccactaaaagaaagagttagacaggacaaaagtctgcaggcataatgaacgccaattagtttcctacaggaacttcaattatttctgctggttcagtgtacaatgtgcacagcatctgcatttgtctttgatctgaaaactgaccctgtatcatcatcatgcagtgctgtctgcaaatggggagacacagacagtcatgaaggggattacccatggagcatgtgactacctgctgaagccagtgcgtattgagca

SEQ ID NO: 711 - DNA, 500 bp, Zea mays
  misc_feature (480)..(480): n is a, c, g, or t
  unsure (1)..(500): unsure at all n locations
ttccaaattcttttccagggctcaaaggattccgctccaatgaaaaaagctctgtaggcatctactagacagaatactcaaaacagtcttgcgtttccttatatcgacatctatcttactaatgtttacagggagctatccttgatattttagaacagttttactgtaatttgaaagcagcaattaccttattcatttataccaaactgccaataaggtccattgtcaactgatggatagagtatttaaggctttacttatttctggacaaagtgttttgttactataacaaaagtaaccagtgaggaatttgcatttaattttctgtccaacgcttattatgcatgcaactctatgtttatatagcaccaaaccaccaatgttaattgaagaattaatatcgattctaagtggatgcctgtttcctcatttactttattcattacaaacgttgattgaagaatttctgtaaatactgantttttattcccttttctgtg

SEQ ID NO: 712 - DNA, 743 bp, Zea mays
  misc_feature (577)..(583): n is a, c, g, or t
  misc_feature (589)..(595): n is a, c, g, or t
  misc_feature (599)..(599): n is a, c, g, or t
  misc_feature (602)..(605): n is a, c, g, or t
  misc_feature (610)..(612): n is a, c, g, or t
  misc_feature (625)..(633): n is a, c, g, or t
  misc_feature (636)..(636): n is a, c, g, or t
  misc_feature (644)..(647): n is a, c, g, or t
  misc_feature (666)..(666): n is a, c, g, or t
  misc_feature (669)..(670): n is a, c, g, or t
  misc_feature (672)..(673): n is a, c, g, or t
  misc_feature (676)..(682): n is a, c, g, or t
  misc_feature (695)..(742): n is a, c, g, or t
  unsure (1)..(743): unsure at all n locations
aaaattaaaaattctattcaatcttaaatctatatatccgttcactcaatcagatatccatttgttttgcccgaaaatatatgggcagaaaaagacgtggtagtatgtaaccacacagtaataccctatctagttccagttcctcacataacagattcgaaaagtaatgcgcaacagagcatgtgccaccaagtagggattcatcaactgaccaacaaaaggaaactctcatcaactggcctttttttcctagagacctagacattgtgtataacagtacaagaggtaattccagatttcgtaaattatctggagtattatcatttaatatcaagttatttactactgagaactaagtcttatttgttaagctacaattatagaattgggataacatctccatcaacatcaaaagaacatgaagaattaaaccagctttcacaaacctggtcatcagaatggtgtgcaataagcaagattcctatctgttgctttatacaaatgtccaatagtttttggtacctgaatttattaacacatgaagatttatcaagctgaataaattgacacaataaannnnnnntgcatnnnnnnngtancannnnaagtnnngcaattatttcannnnnnnnncgncattcatnnnnattttatcatgttatgcanaanngnncannnnnnnctttttataatannnnnnnnnnnnnnnnnnnnnnnnnnnnnnnnnnnnnnnnnnnnnnnng

SEQ ID NO: 713 - DNA, 676 bp, Zea mays
  misc_feature (301)..(301): n is a, c, g, or t
  misc_feature (350)..(350): n is a, c, g, or t
  misc_feature (566)..(567): n is a, c, g, or t
  misc_feature (577)..(577): n is a, c, g, or t
  misc_feature (579)..(580): n is a, c, g, or t
  misc_feature (583)..(585): n is a, c, g, or t
  misc_feature (588)..(592): n is a, c, g, or t
  misc_feature (596)..(601): n is a, c, g, or t
  misc_feature (604)..(605): n is a, c, g, or t
  misc_feature (614)..(614): n is a, c, g, or t
  misc_feature (617)..(619): n is a, c, g, or t
  misc_feature (621)..(621): n is a, c, g, or t
  misc_feature (637)..(638): n is a, c, g, or t
  misc_feature (643)..(644): n is a, c, g, or t
  misc_feature (648)..(651): n is a, c, g, or t
  misc_feature (654)..(655): n is a, c, g, or t
  misc_feature (659)..(659): n is a, c, g, or t
  misc_feature (661)..(663): n is a, c, g, or t
  misc_feature (666)..(671): n is a, c, g, or t
  misc_feature (673)..(674): n is a, c, g, or t
  unsure (1)..(676): unsure at all n locations
actccaaccatgctaaacaattcagtccagaacaagcttgtaaatacggtgtcacaatcactcacaatagagcatgggaggccatggagtttgacaatctcatcaaagaaagcttttgccaccgatgctgctaagggtgacccaaagcagtgaagtggttgtacttggagaaccgatctaccatcgtgagcaccactgatttgtcaccgacctttggaaacccttctatgaaatccatcaagatatcagcccacaccatagatggaatcagcaggggctagagcaggccggcaagatgaanatgttcagtcttgttgccttggcaagtggcacagctgcgcacaatctcncgtacacaacgaagggcctgaggactgtaaacgacgaagggcctgaggactgtaaaagacgaagggcctgaggactgtaaaaagaggtacaccaacggtgaactgtcttctacactccttcatggccagactcatgggcctgggaaaggaacaccggccataaagaaggtgtcaggaatgaaaaccttgccattgaacagtagcatgccatcagtnncaatccatcntnnacnnncannnnnagcnnnnnnctnngtgcaccgncannnanccaaacacattgaganngactnncacnnnnctnngagngnnngtnnnnnntnntg

SEQ ID NO: 714 - DNA, 666 bp, Zea mays
  misc_feature (1)..(1): n is a, c, g, or t
  misc_feature (162)..(162): n is a, c, g, or t
  misc_feature (570)..(570): n is a, c, g, or t
  misc_feature (574)..(576): n is a, c, g, or t
  misc_feature (579)..(580): n is a, c, g, or t
  misc_feature (586)..(591): n is a, c, g, or t
  misc_feature (594)..(595): n is a, c, g, or t
  misc_feature (599)..(603): n is a, c, g, or t
  misc_feature (606)..(615): n is a, c, g, or t
  misc_feature (620)..(620): n is a, c, g, or t
  misc_feature (623)..(625): n is a, c, g, or t
  misc_feature (627)..(642): n is a, c, g, or t
  misc_feature (644)..(665): n is a, c, g, or t
  unsure (1)..(666): unsure at all n locations
nagctataagatggaagaagtctctcgtcagcattttgtccattgcttccttggccattgttggagtaatttttacttccaggtgataagtgtgaaactggtgtaggtgctgaaacatcaagcctgtttccatcaagtctgaccacaattgcatgtgaacangacccacagcgcagcttgtactcatcttttcccaacatgagagaattcttgggaagatgcagtacttcatagcaattgtagcatatggtaaaaggggcaccattggcaattggttcacaagtctgtgcaggttttttactcagggtgtccctcagatgattgtgtcgcatcagaccattaatacctcttggattgtagttctgtgcaccaaacaccaccgggccttctacagggttgttcataagatatggtgccctgcgatggttgaaacccagtggagccccatgaacaggtaataattcacgatggtaacaatgtaagcaagagcaagcaggctgatggtagaagccgtcatggtgataagagatcagagggtcaggatcatactgtccatggaaatagttatcnaagnnnctnnatggannnnnngcnnctgnnnnnatnnnnnnnnnnatatntgnnncnnnnnnnnnnnnnnnntnnnnnnnnnnnnnnnnnnnnnnt

SEQ ID NO: 715 - DNA, 664 bp, Zea mays
  misc_feature (609)..(613): n is a, c, g, or t
  misc_feature (627)..(627): n is a, c, g, or t
  misc_feature (642)..(656): n is a, c, g, or t
  misc_feature (662)..(663): n is a, c, g, or t
  unsure (1)..(664): unsure at all n locations
tgtggcacagccggtctggaaggagaccgcagcaatagtcgatttgagggcatatagcagtgaagaaaaagcaggagggagaagttttgggtggtggccatgcatctggataatgggagaagcaaggtgcgccaagggagagagcattcacacaagagacagaggacgagcagtggcgctgggaatctgggtccccattaaatgtatccatgtaggttacccaggggagggtacatgggctggctgatgggctgggccagctccttcttactcctcccttctccttttttcttttttccctttttcctcagccacatgttagaatttgtatggcactatggcgtagcctttcctcgccttatcaccgcctaggcatcacatagacatttgctaagtgtttggttcgccgaaatgtaatgtaaatggattacacgaggtaatggataccgatacttatgtttggttgagttctttctagtaatactaggtactaatatccaatccaattataactagtgaccattaccgccggtaagggatcccattaccattcccttaacaatatatgaaccaaacatcaccttggaagaagctggctcgctacaactnnnnnatagcaccttaagnaccatgattaaaatnnnnnnnnnnnnnnncacatnnc

SEQ ID NO: 716 - DNA, 669 bp, Zea mays
  misc_feature (63)..(63): n is a, c, g, or t
  misc_feature (81)..(82): n is a, c, g, or t
  misc_feature (85)..(85): n is a, c, g, or t
  misc_feature (131)..(132): n is a, c, g, or t
  misc_feature (277)..(277): n is a, c, g, or t
  misc_feature (370)..(370): n is a, c, g, or t
  misc_feature (378)..(378): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (433)..(433): n is a, c, g, or t
  misc_feature (601)..(602): n is a, c, g, or t
  misc_feature (621)..(624): n is a, c, g, or t
  misc_feature (626)..(626): n is a, c, g, or t
  misc_feature (630)..(634): n is a, c, g, or t
  misc_feature (637)..(637): n is a, c, g, or t
  misc_feature (643)..(655): n is a, c, g, or t
  misc_feature (657)..(658): n is a, c, g, or t
  misc_feature (661)..(666): n is a, c, g, or t
  unsure (1)..(669): unsure at all n locations
ttgcttcatcgacggccgggacggcgcgtcgtccccggtgcacatgaccccgagcttgaacanggccacggcgtcgtcganntanacggccctgtcctggatggtctcgtccacgacgtcgtggagagggnnccccgccttgtacctccgccacgcccactccaccaggcagcagtcagcggcgtccttgctgctgtcgttggctaccctcccggtcgccagctccagcagcaccacgccgaagctgtacacgtctaccttctggttcaccttggcnccgcgtccgtactctgcatccaattccaaccatagcagatcagcagagtgtcgattcatttaagcctcctgagaagaccagaagggttggccngctggtgnctgncgnacggcngattaagaacgcacctggagccatgtatccgaaggtgccacngacggcggacacggactcgggctcgccggacttgagcaggatccgggcgagcccgaagtcggcgatcttggcacggaaccccgggtcgagcaggatgttgctggacttgacgtcccggtgcatgatgggctgcgcgcactcgtcgtgcatgtagctgagccccctcgnngcgtcgatggcgatgcccnnnngngtcnnnnngtncagcgnnnnnnnnnnnnngnngtnnnnnnggt

SEQ ID NO: 717 - DNA, 463 bp, Zea mays
  misc_feature (12)..(12): n is a, c, g, or t
  misc_feature (60)..(60): n is a, c, g, or t
  misc_feature (142)..(142): n is a, c, g, or t
  misc_feature (176)..(176): n is a, c, g, or t
  misc_feature (204)..(204): n is a, c, g, or t
  misc_feature (206)..(206): n is a, c, g, or t
  misc_feature (223)..(223): n is a, c, g, or t
  misc_feature (238)..(238): n is a, c, g, or t
  misc_feature (246)..(246): n is a, c, g, or t
  misc_feature (260)..(261): n is a, c, g, or t
  misc_feature (355)..(355): n is a, c, g, or t
  misc_feature (399)..(399): n is a, c, g, or t
  misc_feature (408)..(408): n is a, c, g, or t
  unsure (1)..(463): unsure at all n locations
cagttgggtganatagtaatttctgttgacacagctcgacggcaagcagaagaaaggggncacacacttgttgatgagataagaatcctcatggttggtttattcctctctttatttcctaataatgtttaactgcaacttntccagttgcataaatggatcaatagtcgtgtggntgttgtcagatttatcaatatagtcatntncatctttgctgcacttngtacctccataatangcaaatangatgttcagttcannctgcactctgaaccttcacaataggagcatacaacattaagaaaatttgtatcaaaggcataaaaaccatagagcactgttttaatggagcagnatctgatatttaaaagctgcctgcaaaaatagagactaaaggtnatggcgagntgcacaatgcactagtgctcaactgcttgtttccatcagccattgtgtatcaaca

SEQ ID NO: 718 - DNA, 474 bp, Zea mays
ggcaggggtcaggtgcgtgaacggccaagtgtccgccctgtccttccagaacctcagcatagccaatccagttccagtcccagctgcttccatatgcaacctcaagaacctgtcgtatctcgacctttcctacaacaaactcaccggccagttccccacagcgctctacagctgctcggctgctcggttccttgacctctccaacaatcgattctccggtgccctcccagctgacatcaacaggctgtcgtcggcgatggagcacctcaacctgtcgagcaatggcttcacaggcagtgtgccccgggcgattgccgcgttcacgaagctgcggtccctggttcttgacaccaacagcttcgacgggacgtatccgggctcggctatcgcaggcctcagcgagctcgagacgctaactctggcaaataaccccttcgtgccaggccccatccccgacgacttcgggaagctgac

SEQ ID NO: 719 - DNA, 649 bp, Zea mays
  misc_feature (29)..(29): n is a, c, g, or t
  misc_feature (31)..(31): n is a, c, g, or t
  misc_feature (84)..(84): n is a, c, g, or t
  misc_feature (100)..(100): n is a, c, g, or t
  misc_feature (122)..(122): n is a, c, g, or t
  misc_feature (299)..(299): n is a, c, g, or t
  misc_feature (360)..(360): n is a, c, g, or t
  misc_feature (500)..(500): n is a, c, g, or t
  misc_feature (628)..(628): n is a, c, g, or t
  unsure (1)..(649): unsure at all n locations
gttcagttcacctcgcaacctgttgattngngagtgacacaaggaactcatagttagaagtaataaaggaatcagtgctgttcnccaacaaaaagggctntgtagatcacaaattaggttanaaacatactggacaagtttgtcaacacgtgcatctactgtcaagtagtaatgaggaatggtctgtttcgatgctagcaagcgatttgcagtaacctgaagacaacaaaaggtcaatacattatcaggctgttatcatctaatatgaaaatgatgcctaacattctggccatcaaaanttacctttcttatctgtgcatttggaatatcaacataacctaaccctggatctgcaaaagnctccctcagcccacccttggctacagaagcttcattaagacattaacacagggggtcataagttaggttacagttagttcagctaaatgaagtcaaaatgccaaatcatgggatattattacaagtttattaccaaaatnaaataagatacaggactcatgatgtagtgagggcctgtgaggccacaacattatataacctaaagtcaaataattaagtaactacaagtgtaacaataactcagggaaaccgagcgaattgaactttnctctgcaaaatctaactagca

SEQ ID NO: 720 - DNA, 582 bp, Zea mays
  misc_feature (118)..(118): n is a, c, g, or t
  misc_feature (397)..(397): n is a, c, g, or t
  misc_feature (412)..(412): n is a, c, g, or t
  misc_feature (427)..(427): n is a, c, g, or t
  misc_feature (457)..(457): n is a, c, g, or t
  unsure (1)..(582): unsure at all n locations
cttgtagtggttgaccaccatggccgacagcgacggcgtcgggttgaacaggctgcagttcaccacgaggatcccgatgtccttgggcttgacccccgtcttggcgagcagctcgtcnacggcgccgaacatgacctcccgcgcctccgcgcgcgcctcgtccatggacgggttgggcggcacccgcgtgacggcggggggaaggtacgtgtcctcgcccagccccgagcgctccaggatcttgcgctggaactcgaggctggcgtcggtgaagcagccggtgagcctggagcagcgcatgaaggtgtcgcgcgtgcaccggcgctccggcccgggcttgtagcaggcgaagtcgaccaggtacacgggccgcgggcgggtgaggaagtaggccgtnccgaggaagacgagnagcgtggagcaggcnagcacggagatgaggttgaggcggaggtgngcccacaggtcggcgacgtcgcgcggggagagcgtggagaggtacacggccacgagcaccatcagcggggtgagcagcaggtacatgccgtgggtgatgaggtaatggtaccccagcttcacgta

SEQ ID NO: 721 - DNA, 507 bp, Zea mays
  misc_feature (308)..(308): n is a, c, g, or t
  misc_feature (327)..(327): n is a, c, g, or t
  misc_feature (340)..(340): n is a, c, g, or t
  misc_feature (346)..(346): n is a, c, g, or t
  misc_feature (348)..(391): n is a, c, g, or t
  unsure (1)..(507): unsure at all n locations
gcgcgttctccatctgctcgcggtggtacggctgcccgcactgcggcaccgcgcatctccactcctggccctggagtgccgagtcgcggcagagatccaggtcccggcaatcgttgcaatagctgccagtgtagttgtttcataaggtttgctaacatcaagattcaagagaaaaaataatgaaaatagctcttgaatctgtccgttatggttctaagattggaacaatttccagctaaagcttacatttacaaattaagcagtaaggtgagaactggcaagaggagcaagaaacactatttggttcngattctctgattaacattntcctgtttgttgntttttntnnnnnnnnnnnnnnnnnnnnnnnnnnnnnnnnnnnnnnnnnnnntccagctcatgtgctttgatgcaagcacaaagataaatagctaaaatactatcacaaacgatcatgcaaggatgcaacaaactttccacaaacaaatctggttcatagataaaata

SEQ ID NO: 722 - DNA, 568 bp, Zea mays
  misc_feature (1)..(1): n is a, c, g, or t
  misc_feature (223)..(223): n is a, c, g, or t
  unsure (1)..(568): unsure at all n locations
ntacaacaaggccgggccgatgcttcagggcaacatcgaggatccagcaatgacaatgacctgcagtgattttgcagttagccacatattggtaatctcgtattgaatcacaaaataattgagatacagacatttcagtagtagacaacggcaccttatcagtatcactaaaggcccaattattaccagatatcttgatggccatggcgatgtaactcatttntcttctctttttcccttttgcaattcttttgccagatgaacataataatgataacaaaaaagtacaatatattaaagtctctcataaacgaccaagttttgccagaccggcactaaagcctgttcgctgcggctttaatccatcggcttgtgtttttttatagcagcagttttggctttcaccatcttcctaattgtctgcaagggtacgcttgggtatactgatgtacagaactgcatattcagaagactgctacaagaatttgcccgacatagatctcagaatattcacatcatataatccgcaccaccatttcctcttatgaaggcatcaccttcttctttc

SEQ ID NO: 723 - DNA, 613 bp, Zea mays
  misc_feature (476)..(477): n is a, c, g, or t
  misc_feature (483)..(483): n is a, c, g, or t
  misc_feature (486)..(489): n is a, c, g, or t
  misc_feature (503)..(503): n is a, c, g, or t
  misc_feature (505)..(505): n is a, c, g, or t
  misc_feature (509)..(510): n is a, c, g, or t
  misc_feature (512)..(513): n is a, c, g, or t
  misc_feature (519)..(520): n is a, c, g, or t
  misc_feature (522)..(524): n is a, c, g, or t
  misc_feature (528)..(530): n is a, c, g, or t
  misc_feature (532)..(538): n is a, c, g, or t
  misc_feature (540)..(541): n is a, c, g, or t
  misc_feature (545)..(552): n is a, c, g, or t
  misc_feature (554)..(556): n is a, c, g, or t
  misc_feature (558)..(573): n is a, c, g, or t
  misc_feature (575)..(603): n is a, c, g, or t
  misc_feature (607)..(607): n is a, c, g, or t
  unsure (1)..(613): unsure at all n locations
gcagctctgcgtgaacatgctgtcatcccttcgagtgatctgaggacccaggggtgggcagcggggtgggaggtgtggcgaccgagacatggcgagaaaaagccctcgtatctttgatggccttcctcttttggttctgctaagtaactagagccaatcgagcatcccttgcgctgttcctttcatatggaaaaacagcagctttgggtcagatccgaatgtaaaatagcctgcattagggtttgggaagggtttggtgtgctcgatttcgcacagcaggaagaggagttgctggcatacctggtggatgcttgtttccagccaaagggccgacgaagacctggcgaaggtcgacgcgggtgcccagtcggcgccgccaaaagtgaggggtgtgagtagtgagggaggagaaaggaaagggaggcgtgattcgggtgaacgcaatcgtcgaggacgcggttgatcaacgcaaatgnnccttgnggnnnngaagctggcggcgnancganntnngccttnngnnncagnnntnnnnnnntnnctcnnnnnnnncnnncnnnnnnnnnnnnnnnncnnnnnnnnnnnnnnnnnnnnnnnnnnnnncgtntgccca

SEQ ID NO: 724 - DNA, 717 bp, Zea mays
  misc_feature (622)..(622): n is a, c, g, or t
  misc_feature (624)..(625): n is a, c, g, or t
  misc_feature (652)..(652): n is a, c, g, or t
  misc_feature (659)..(667): n is a, c, g, or t
  misc_feature (678)..(679): n is a, c, g, or t
  misc_feature (682)..(699): n is a, c, g, or t
  misc_feature (701)..(716): n is a, c, g, or t
  unsure (1)..(717): unsure at all n locations
tccatctggggatacgttctttagtgagccaccgtgctggctcgatgatctccttgcagattccgggaaagctcccaagcttcctcctctcagaagggcctgtagcgattctgatgccatcttggatgctctgtcaacatttgaaagcccaatttgtcgaattgaggaaggcaatcaaatctctggtggtgaagctgatgacttgttggatgctggcgaaggtggtgaaagcggttctgtggtcgaggctagctgtgtttatggtccgaattcaccaagacagaagagtaggctgacaacttcagagagttccatggtaaatgctgtgcttgagaatgtacccagcaaccccttgcagtacttgagcatcgatgcctccagcggtatgaatggtaatgtggccaatggaactgctgatacctgtgatgcttttggccaccctgatcaagacaagtcatttaaaaggtacacttacatttgtgagtgaaatatctaaaatacttccttcgaatattctctggtaaagtagcggtacattgctgcttttactaaactggagttttttagtgaaaatgctagaaagatataaattatcaagtgcagatgtgaactttggctctcncnnacagaaatggaacacgacactctactnctttgcnnnnnnnnnattaactgatnncgnnnnnnnnnnnnnnnnnntnnnnnnnnnnnnnnnna

SEQ ID NO: 725 - DNA, 470 bp, Zea mays
tgattctattgattgcagttttatattgtgatgttgtggaggcatatgagtaccatttttttttcttcttaatatagcactagtgttctgataggcgcaggaaatcaacagctcgtgcagatgggtttcttcgagcaccctctcttgtcgacaaccttgttatattttagaagttatttgtttgacatccatccatccatcttctctccaaatttaggtcggatgtacgagctctatcgacgttatatttgtgcctccgcgagtccgagctgacccagcagcgagtcaggtaccagcagtagagttgtttgttttgtcgtcccatactgaaaatctatcatctatgcacatctcttgcctgatccccctttcgccttctgtatcgtggttcagaatccagcagttgttgccaggaggatggttctgaagtcaccacgcctaaggatcaaaaggcatgtcgtagtggcaca

SEQ ID NO: 726 - DNA, 745 bp, Zea mays
  misc_feature (346)..(346): n is a, c, g, or t
  misc_feature (361)..(361): n is a, c, g, or t
  misc_feature (372)..(372): n is a, c, g, or t
  misc_feature (476)..(476): n is a, c, g, or t
  misc_feature (555)..(555): n is a, c, g, or t
  misc_feature (630)..(630): n is a, c, g, or t
  misc_feature (700)..(700): n is a, c, g, or t
  misc_feature (716)..(716): n is a, c, g, or t
  misc_feature (725)..(725): n is a, c, g, or t
  misc_feature (732)..(735): n is a, c, g, or t
  misc_feature (742)..(742): n is a, c, g, or t
  unsure (1)..(745): unsure at all n locations
ccggcgcgattagctgccttactccgtggatcgcgtgatcgaacaggagtgcatgctgtcccaaagcctgaactggattgtgtgtggggggttttggattgaattcagcctgctgcgatctctttgctgttgtaacttttgggatttatcgagccgtttgcactggttcgtgcactctgcatcgattagggcttgatggtttaacgcttcttgttttggcaactaattgatgcagcgccggcggtaatgcgaccaggaaagggatgacttcaattgacattcagctactagcctactatgctctgtttatgttctgaagtacacaaatgtgctgtatggactatgnagtggtgaggacaantttgcaacggntatttaggttggtcagtatgtggtagttggtcacttgatcacactagactggtggtgcagttgatctcatcgctattagcaatttagcatactcccactctacnctgcaaattcactcgattgatcacacaagtaacaagtttagcaactggttaaaatattctgattgaggtgatccaatancaatgagataataatcttgaatcatttctatgctgttaggtatcgctgggatgttgtattcctgttcttgcatgnttacactttacaataccagacaattatttattttctagagcagcaactccaagaggctctctatattctncctaattgatataacnaaactgctncacaacnnnnatctacnggg

SEQ ID NO: 727 - DNA, 691 bp, Zea mays
  misc_feature (15)..(15): n is a, c, g, or t
  misc_feature (78)..(78): n is a, c, g, or t
  misc_feature (98)..(100): n is a, c, g, or t
  misc_feature (109)..(109): n is a, c, g, or t
  misc_feature (178)..(178): n is a, c, g, or t
  misc_feature (384)..(384): n is a, c, g, or t
  misc_feature (403)..(403): n is a, c, g, or t
  misc_feature (452)..(452): n is a, c, g, or t
  misc_feature (537)..(537): n is a, c, g, or t
  misc_feature (592)..(592): n is a, c, g, or t
  misc_feature (649)..(650): n is a, c, g, or t
  misc_feature (656)..(656): n is a, c, g, or t
  misc_feature (658)..(658): n is a, c, g, or t
  misc_feature (664)..(664): n is a, c, g, or t
  misc_feature (668)..(668): n is a, c, g, or t
  misc_feature (676)..(676): n is a, c, g, or t
  misc_feature (680)..(680): n is a, c, g, or t
  misc_feature (686)..(688): n is a, c, g, or t
  misc_feature (690)..(690): n is a, c, g, or t
  unsure (1)..(691): unsure at all n locations
gcagctgacaagagntttgccaacagatatgttagcatttgatttctgtgatatggtttagcagatgttgtggcccanctttcatgttcctaaataannnaaggtttcntattctggtcacatctttgcaggcaagagctgaggatattttcacaagaagtcataagatttgggaatngttgcaaagatcctcagtggcacaacctagatcgttatttctccaagtagggtcccactgtttacatggcttaatgattgattgctagtgtaatgatctcactagtccttgtgtttgtttccaggctagagtcagaaattacaccccaaccacaattaaaagaaacggcgaaagcagatatgcagcaactgatggcccttgttcgncacactggtgtgagtatcncacatgttgacaaaaatctctagtgttcttacagaaaataaattgtgtnagactacattttgctcacctttgcatgtcatgcaatcagtatgattcatgtagccattcctgatgttgttgctgttccactttgncccataggatctctaccatgaattacacgcactagatagatttgagcaagattancgccgaaagttggaggaagagaaaagatcagttacatctgaaaggggtatgtcgatnntcatcnangtatcncccntgtcgctncagntgctannntnt

SEQ ID NO: 728 - DNA, 682 bp, Zea mays
  misc_feature (32)..(32): n is a, c, g, or t
  misc_feature (519)..(519): n is a, c, g, or t
  misc_feature (559)..(561): n is a, c, g, or t
  misc_feature (571)..(571): n is a, c, g, or t
  misc_feature (591)..(593): n is a, c, g, or t
  misc_feature (596)..(599): n is a, c, g, or t
  misc_feature (601)..(601): n is a, c, g, or t
  misc_feature (625)..(625): n is a, c, g, or t
  misc_feature (660)..(661): n is a, c, g, or t
  misc_feature (663)..(663): n is a, c, g, or t
  misc_feature (669)..(670): n is a, c, g, or t
  misc_feature (679)..(680): n is a, c, g, or t
  unsure (1)..(682): unsure at all n locations
caaagcgacaagcccctgtcttgagatgaaanggacaatgggccttatcctaaagaaataaaagaaacagaaaaaggtaaaatgtcaagtagagaacaagttgtattttatttctgttgtaacagaataaatatatagggcatttctgtcctaatagatagagaacaatggagcatgcctgttctgttccaaaattcggagtctcttgagcaactttgtcaagtacttcttgagcagacaaagaaggttctctcctatgagcagccaaagcaacagactgtggtgggagcggatttgatgtaggtctatcttcctacaagacatttagagtaacctttatcggcagtatgttcaaaaaaattgccccacaagcagccataaggaatagaaccaacagaaatttataacaaatagaatgtgacctcctgaatttgcagcttttccttggacccctttggtactttaacctttttcttcttcacaatgatctcatttcctttccatataatttctgctggnccatcttcaacatattcccattcactatcttcttctgacnnntttccttggncatctttaggctgcaagagnnnagnnnnanttgtaaccagatcactattttagnatgtttctacaacttatttttgaaaacatgaactnntnaatttnnagtgatggnnta

SEQ ID NO: 729 - DNA, 712 bp, Zea mays
  misc_feature (265)..(289): n is a, c, g, or t
  misc_feature (541)..(606): n is a, c, g, or t
  unsure (1)..(712): unsure at all n locations
ggccgggtgaggaatgcacttggtagatactacctgaataacttcgttgatgggactaaggcgaggtcatatggcctcttccaaggacattacatgacatctgttagtagagatatggcagtgccaagcaaagcaggacttctgcagagttatgcgtccttccgccttgcttttgcattggttatgggagctctaatgttcatgttgatgtcactgagacaggcccggaatgatgttcgtcatttgttgctgtcacttatgtggnnnnnnnnnnnnnnnnnnnnnnnnnattttgttagagccaatggtcgcacgttcactaaccaacctaggtttcacaagtcacgccattgatggttgcaagatgaccaatttgctcgtcaagcggcctcatagattatcatcatccatcaaacttgttgacacagattggttcacatgaagtgttgcgtttttttggcacggtatttacccttttgtaataaggtttcttccattttgtaacaagtttttgtttcctcgtcgcctacttttgcttcannnnnnnnnnnnnnnnnnnnnnnnnnnnnnnnnnnnnnnnnnnnnnnnnnnnnnnnnnnnnnnnnncacatattattgtattatgatttgttcatgctacaaacgaagtgaatacgccttttgtgatttgttcatttgtaataaaaagtttgaatactccttttgtgcactc

SEQ ID NO: 730 - DNA, 684 bp, Zea mays
  misc_feature (172)..(172): n is a, c, g, or t
  misc_feature (306)..(306): n is a, c, g, or t
  misc_feature (347)..(347): n is a, c, g, or t
  misc_feature (369)..(370): n is a, c, g, or t
  misc_feature (424)..(424): n is a, c, g, or t
  misc_feature (429)..(429): n is a, c, g, or t
  misc_feature (478)..(478): n is a, c, g, or t
  misc_feature (493)..(494): n is a, c, g, or t
  misc_feature (540)..(540): n is a, c, g, or t
  misc_feature (562)..(577): n is a, c, g, or t
  misc_feature (579)..(579): n is a, c, g, or t
  misc_feature (590)..(595): n is a, c, g, or t
  misc_feature (606)..(609): n is a, c, g, or t
  misc_feature (643)..(647): n is a, c, g, or t
  misc_feature (649)..(672): n is a, c, g, or t
  misc_feature (674)..(679): n is a, c, g, or t
  misc_feature (681)..(683): n is a, c, g, or t
  unsure (1)..(684): unsure at all n locations
agcgaaagagcctaggaagacggataatgtcctgcgatcatgcgtcatgggacatataactagagggaaaagacttgcattaggatgtactcaaatacagtagtaatatgcgtccactctgtcttagcatctatatttctatctcaaaattaataaaaagatgttagaaagncaagctcaatgttgactaataaatacaaataagcatggcatttgcagaaaaatagaattatatagatggactctttgcacatcagcaatatactgaacttggtgcacattccagtgaagatttaagtgactggncattagttatttgggggaattgtatggttgcccatactcangaatgtagcttcgtttttaccnntgttttttaaagtttgcacgtatgtccctccttttttgaaacaaacagacaacncttancggtgttaactcagcccataaaaagacgttcatacctttgtactatatnccctcttcttttatnnattttctgcaaatttgtcctaagttttatatgaaagtttaggatanaattgtgacataaatctgaccnnnnnnnnnnnnnnnngnacaccattttnnnnnnggattcctatnnnnccaaaggaaaatgaactaatttcccttgaaaaannnnnannnnnnnnnnnnnnnnnnnnnnnncnnnnnngnnnt

SEQ ID NO: 731 - DNA, 1187 bp, Zea mays
tattatggatgggtgagctcatctataatataaacgtgaactacatattcactgcaaatagaataaaagttatagaactcacctatttaaaagtttcctcataatatttatcttttgtgaatgtgaactactgaacttgggaatcaaataaaaaagcaacattcctttatatgtattcctttgaatttctgattgaatgacattcctataatcttttttctacgtttacatattactggcagtcacctctatgagttagaacaacaccttgaccgcttcctgaagtctgcatcgatggccaaaataccattacctttcaatcgctcaacaattagaagcatacttattcagactgtgagtgcatcaaattgcacccaaggatcactcagatactggttgtctgctggacctggagacttccagttatcttcatctggctgtacaaacccagccctctatgctgttgttattgaaagcccatccttacaagtaccgtcctgctgcagaatcgccatatgcccaactagatcagatagtgggtggccatgcggggtatgctgatacaatcctaagctacaacctaactgcaacaaactgcttcagcaatgccaggagtccaggactgaacagcactgaagcagtcaatctggatcgaattgaacaagtgctggacagtcagtttccacatgaatcagcactgaaacatccggatgagcaaaaggagaagaaggcttgtgtggtcgtgcggaggtaaagctttgacctttgtgcggcttcggcctggttctggtagaacttggcgaagcggccgcggttggctggcttgggtttagagggctttttcgggcgcaggccggcgatctcctgcaccagcggcacgtgcaccagcaccgtcctccacgccacgtaccagcctggggcgacgaagcggatcagggaagggaacccacgcaactattcaactgaggagataaggggaggggagtcatactgaggaggatgagggtgaagacgaaggcgatggcaaggacagggcggatgaggaaaacgacggcgacttccgacgcagccgccaggccgccgctcgccatagcgccggcggcagctcagttccggcctcgcaaggaagggatccgctggcgaggttattgagcctatggcatgcgaggcccgcggaagcaagcaaa

SEQ ID NO: 732 - DNA, 235 bp, Zea mays
tattgagagaaagttcttgcaccaagacgtgtggcatcaaatgataatgatcaaagcaatattgctggatcaaggattgtcttaccaatagtcagtctacaatcagaatacctcaaagctgatcctgagaagagtgaggcaagcaaaaatgtacctattattaataggtcaaaaaaggtatcaaaggtaatatcttgatatcaaatgttgtgaaaatatatataatatattttgt

SEQ ID NO: 733 - DNA, 677 bp, Zea mays
  misc_feature (213)..(213): n is a, c, g, or t
  misc_feature (262)..(262): n is a, c, g, or t
  misc_feature (413)..(413): n is a, c, g, or t
  misc_feature (567)..(568): n is a, c, g, or t
  misc_feature (583)..(587): n is a, c, g, or t
  misc_feature (636)..(636): n is a, c, g, or t
  misc_feature (638)..(640): n is a, c, g, or t
  misc_feature (652)..(664): n is a, c, g, or t
  misc_feature (666)..(666): n is a, c, g, or t
  misc_feature (673)..(676): n is a, c, g, or t
  unsure (1)..(677): unsure at all n locations
tgcctgcagtaactagtgccatgacccatgcattaacctatgcaggaaaaggttgtccttttacttcatggatttcttggtacaagtgaagactgggttcccacgatgaaagctcttgcccccagtgcacgggtaattgcaattgatcttcctggtcatggcgagtcaaagatactgcaacgtcacaaaaattcagaacaacctgctgtaacngttcaactagttgcagatttgttgttgaagttgatataccacataactnatggtgaggtggtggtggttggctattcaatgggtgcaaggattgcactccacatggcactaaatcaagatcacaaggtaactgtgtttttacattttgtgtaaactttcttttctgaatgttctataaagcttgttgtgccaaacagatncgtggagctgttacaatatcaggaagtcctggactgagagatgaagcaagcagaagacgccgtattgctattgataaatcaagagcccagttcctgatgtgttgtggacttgaatgttttcttcagacatggtactctggaaaactgtggaccnngtaattatttgatgnnnnnactagcttgtttgattattgcctgtacaaaatggtaaatttgtatgcancnnnagcactcatttnnnnnnnnnnnnnanttctctnnnng

SEQ ID NO: 734 - DNA, 629 bp, Zea mays
  misc_feature (17)..(21): n is a, c, g, or t
  misc_feature (183)..(183): n is a, c, g, or t
  misc_feature (189)..(189): n is a, c, g, or t
  misc_feature (532)..(536): n is a, c, g, or t
  misc_feature (549)..(551): n is a, c, g, or t
  misc_feature (553)..(553): n is a, c, g, or t
  misc_feature (556)..(557): n is a, c, g, or t
  misc_feature (563)..(563): n is a, c, g, or t
  misc_feature (567)..(567): n is a, c, g, or t
  misc_feature (582)..(588): n is a, c, g, or t
  misc_feature (593)..(595): n is a, c, g, or t
  misc_feature (602)..(605): n is a, c, g, or t
  misc_feature (610)..(615): n is a, c, g, or t
  misc_feature (617)..(621): n is a, c, g, or t
  misc_feature (623)..(626): n is a, c, g, or t
  unsure (1)..(629): unsure at all n locations
taatcctgattctcaannnnngcaaactcaagaaacaccgggtgctgttgcttctggtccaagctcaacttcagctgttgcaaaccgtgtgacttctgtggctgagggcaaacaagaggcaacggactgctccttgcaggtggctccatccaagccaaatgatccatctcccgctgatctggngaaganactgtcaggttcgatagagcagattgaaaagatggtgaggcgccatatgaaggaaactcatccaaaggctgctcagccttccaaggtagttgtccaaaggcgcatactgatgtccatgcgatgagctcagcaacgatttctcttgtctgctgcgttcttggccgctagtcaaggtatgtctagggatggggattcctggttctctgcttgaggacactgtggtaggagtaaaagagggatttctagcttctctgcttgagagcatggctatctgttggtacaacttgccatggtatgcttactgcatacgacttcagttggcttcaccagaaacgaaccactnnnnntcacgtctttctnnntntgnngtatangacntcactgcgtagtagnnnnnnntactnnntatttgnnnngtttnnnnnncnnnnnannnngag

SEQ ID NO: 735 - DNA, 740 bp, Zea mays
cccatactgccatgattcatttatgtccactgttagctacaatctcatggcatgtctagttgtttgcactcaatacaaaattgacttgtgccatcaattagaagcgatcttctagtgttatttttttaaattacttcacaggaaaaaatcattgaagaataaagaattgaattttgtgcccaaactcatttgtattcactgtgttctgcgtgaaagcaagaaaggcttgcttgctggatgttctttttggaagagtttgtctatggtgtgctagagttcatgtgtctaaggttagttgcttgttcaatcgtcttgtggagcactctatctgccaatcgtctttaattgcttgttcaatcatatagggcatgtttggcttgctgcctaagacaccacaacttgcataacttttctgtctaaggttagttctcaattggagcgattaaacttaggaagactgtggcaccttaggtatgaaaccaaacaggtcatcgcttctgcttagtaatgaatagaatttcaattgtgccactgttgaacgggaggtgaatccaacttttgtttgaacaccagttgtttgtggcccttgttgtctttacagcaatttagttctcatgcctccatggacatataggatgctcagaagattttaattagtttttaagcacattgcctcttactctctttgttactcttaaaacattattagcactctccaatccattctgccacttgtggtt

SEQ ID NO: 736 - DNA, 1002 bp, Zea mays
  misc_feature (159)..(159): n is a, c, g, or t
  misc_feature (162)..(162): n is a, c, g, or t
  misc_feature (171)..(171): n is a, c, g, or t
  misc_feature (183)..(183): n is a, c, g, or t
  misc_feature (189)..(189): n is a, c, g, or t
  misc_feature (195)..(195): n is a, c, g, or t
  misc_feature (220)..(221): n is a, c, g, or t
  misc_feature (225)..(225): n is a, c, g, or t
  misc_feature (241)..(241): n is a, c, g, or t
  misc_feature (247)..(247): n is a, c, g, or t
  misc_feature (276)..(276): n is a, c, g, or t
  misc_feature (383)..(383): n is a, c, g, or t
  misc_feature (578)..(578): n is a, c, g, or t
  misc_feature (644)..(646): n is a, c, g, or t
  misc_feature (706)..(706): n is a, c, g, or t
  misc_feature (889)..(889): n is a, c, g, or t
  misc_feature (922)..(922): n is a, c, g, or t
  unsure (1)..(1002): unsure at all n locations
aatcgtttagctcatcttcagggatcgtgtgtctgttggtctgcggctactccgttcctaggagtggttgaggacgatacttttttttaataaatagatagataaaccagctactttaatcttgtactctgcgagatttctttattccctcgtctcctngtntacggtatntttttttgtaanaatcantaatgntatatgcttgttaatttgttctttnntagngacttaatatattgcnttagcngaacctcatataaattgtgtgattaatantaccttctcagcctttgtaggtatttatctgagggaagaagaaactatacaattcatcatgtcaggagggtcgtctgaatcttccccgttatctggacaaaatagcnttagttctctatcaatttccaaggacaatgaactatcttcagagtctggctgcttgtccattgttgtactaggcgcttctggagaccttgctaagaagaaaactttcccagcgctctttcaccttttccagcaggtaagttaatatcactagcagttttgtacttaatatataaagccttcaaacagagaattanaaacaaatgcatagtttgatccatctcttctttggttataccatgagtgcgcagtataacaaaaannntgtagaacatcatagtataatgtatttgcatttctaaattataatatgttcatgtaagtntcttaggttggcgcatgtacaaacttgtgaatcttactcgctgccttgtttatatctacagggatttctgcaatctggagaagtccatatatttgggtacgcaagatcaaatctttctgatgatggattaagagaacgcattcgtgggtaagatctattttccttgaattggtacaagaattnatgtacagaatcgttacctctgtataatgtgcnccttcctgttaactcatatttttgatacgatggaaagattccatgattctttctctatttgaatatataaatggtctatt

SEQ ID NO: 737 - DNA, 857 bp, Zea mays
  misc_feature (563)..(563): n is a, c, g, or t
  misc_feature (614)..(614): n is a, c, g, or t
  misc_feature (684)..(684): n is a, c, g, or t
  unsure (1)..(857): unsure at all n locations
gtgcatgcatgcatgcatggacgggtcgggcagaggcctggccaccaccaccaccactggcatgcatacgatacgacgcgtacctttccgtgcctctctgtgaagcgactctgacggcgagaagcgatcgaacaagcaagcaggcaagcagcaggtccatggctacatccgcctgcgttctttctttctgttggaacaaggggcgatgtaggagatctgcccttcccatgctttttcctccaggttcggaatcgaaaggccctcgctttcttttagtttgccctactagtagttttagactagaaaaaacaatgggtgtccatccagaatccaaggcccccagtttcggaagcagaagtgattcaagctcttgttccagcgctatctgaaaaagaattttctaaggaggaccaccagactttttgcttgaaccttgaaaggtaatattcataaataggacccttgcagtttagctttgtggacttcactagttcgcgcctttgacacatttacactgtgcatgtttatgtatgtatactgttcattctagttatcgcaaaagnaattggggcacattttcatcttatctttagctagttgttgtttctttatcncatttatgccatggatgtttatgtatacttttgttccttttgctttcacctgataactatattttttacntatttcaggctactgattctatggttacttgataataagggtgttttccaaattgttgtggacttcatttgttctaaaaagcatggtgaagatattctcagcccagataaaacaatatccgtatcaagggttgcacaactacttgcatctgttccagataaagcaagattggg

SEQ ID NO: 738 - DNA, 551 bp, Zea mays
tgctggccctgctgcgcaccggtgaagttgaactcgggcgtcttcatcttccgggcactgctgccactggcattggcggccgttgatggatcatgctgctgaccttcgacgccaccaccgcctccggctttatttgagcgtggataccctgcgtagtttattcccattaattccaaccagccgcgcactatattatctaactgtcagctttttcgatcgagagattaaagaagctgtgtcaacttgccaagatggttaatgcatggactgaaccagtgggcaactagctaatataatttacaaacttgactgtccatttggtagctctcttcctgatgacgaagaagaaatctgacgctagctcttgtcgaactaatttaaacacggagatcagaataacggaagacgtcggccaaactacacaagatccggcggtgtggccgttaggaggaggagcgcacaaagtgccaagacactttgcaacttgcatatataggctactgtttttagcaagagtgcaagacggcggtgacgtcacggtggagccgtca

SEQ ID NO: 739 - DNA, 468 bp, Zea mays
  misc_feature (46)..(46): n is a, c, g, or t
  misc_feature (55)..(55): n is a, c, g, or t
  misc_feature (58)..(60): n is a, c, g, or t
  misc_feature (75)..(77): n is a, c, g, or t
  misc_feature (177)..(177): n is a, c, g, or t
  misc_feature (197)..(197): n is a, c, g, or t
  misc_feature (274)..(274): n is a, c, g, or t
  misc_feature (299)..(300): n is a, c, g, or t
  misc_feature (415)..(416): n is a, c, g, or t
  misc_feature (467)..(467): n is a, c, g, or t
  unsure (1)..(468): unsure at all n locations
gaacgcgagcacccgtctctgccagtggaagggcgtgacgtgcgcngacgacccnaannngaacaacggagcagnnnggcgagtgacggagctccgcctcgcggggctcgggctgtcgggcgccatcgccggctccgtcggaaacctgaccgccctccgcgtcctcgacctgtccancaaccggttctccggccggntacctgctgtcgacagtatccgcggcctccaagtccttgatctgagcaccaactcgttagaggggagcgttccagangcactcacaaactgctccagcctgnnaaggttgtggctctattccaacgcgcttacgggttcaattcctcgaaatataggctacctttcgaacctagtaaatttcgacctgtccgggaacaaccttaccgggaccatcccnncgtcgatcggaaacgccagcagactggacgtgctgtaccttggtggaaatna

SEQ ID NO: 740 - DNA, 583 bp, Zea mays
  misc_feature (22)..(24): n is a, c, g, or t
  misc_feature (27)..(37): n is a, c, g, or t
  misc_feature (39)..(39): n is a, c, g, or t
  misc_feature (43)..(46): n is a, c, g, or t
  misc_feature (48)..(51): n is a, c, g, or t
  misc_feature (53)..(55): n is a, c, g, or t
  misc_feature (492)..(494): n is a, c, g, or t
  misc_feature (498)..(498): n is a, c, g, or t
  misc_feature (530)..(535): n is a, c, g, or t
  misc_feature (539)..(548): n is a, c, g, or t
  misc_feature (568)..(580): n is a, c, g, or t
  misc_feature (582)..(582): n is a, c, g, or t
  unsure (1)..(583): unsure at all n locations
ttttcttgtactggatgaagtnnnccnnnnnnnnnnntntaannnncnnnnannnatgcatagaattttggagcatgttggaaggagacctggaggcacatctagggatattcttggcccacttgcgagacgatctgagcgtcagactatcctggtttctgcaacaataccattttcagttatacgagcagcaaggagttggggtcatgatccagttctcattagagctaaaagtgtagttccacttgattcaatcactgtgccaagacctgcgttatcccaaagtgacgctaaccccagttcgtcatcgcagtcagtgaaccaagctgctgttggcagcttgccgccatctttggaacactactattgtacggccaaggcgcagcacaaggttgacacattacggaggtgcatccatgctctggaagcacagacagtgattgcatttatgaacaacaccaagccactgaaggatgttgtgtttaagttggnnncccntggtatcaaagccactgagctacatggagacnnnnnnaagnnnnnnnnnncgacagttttgaaaaagttnnnnnnnnnnnnntnc

SEQ ID NO: 741 - DNA, 507 bp, Zea mays
  misc_feature (324)..(324): n is a, c, g, or t
  misc_feature (404)..(404): n is a, c, g, or t
  misc_feature (460)..(460): n is a, c, g, or t
  misc_feature (462)..(468): n is a, c, g, or t
  misc_feature (482)..(494): n is a, c, g, or t
  misc_feature (496)..(505): n is a, c, g, or t
  unsure (1)..(507): unsure at all n locations
cagaaccatgtcaggcagtttctagtgggagttgtcggacacatgaggatacggacataataagcgggatattttgagtagaatttagtacgtcagttccccggaaccttacccaggtcagcagtgagaagggcctcactttcgtagttgggacccgccaacactgttcccaatggtgagatgatgacactccctccagaacaaacaacggattccggggatggctcttcctctaggccacaaaatgtgtactcgggagggggagggtagttctttctacgacagaactggcacgctgacagcacaaagcatcccccttcaagngcgatatgtgtcatagaagacagccaagttggcatgcaatcaaccgtgggagcacaatatatctcaatacctgcattaanattaacataggaggattcagcatgaaagataaactcagtacatgagacattgtgcnannnnnnnttacaccatgagcnnnnnnnnnnnnncnnnnnnnnnnat

SEQ ID NO: 742 - DNA, 610 bp, Zea mays
  misc_feature (39)..(39): n is a, c, g, or t
  misc_feature (153)..(153): n is a, c, g, or t
  misc_feature (200)..(200): n is a, c, g, or t
  misc_feature (374)..(374): n is a, c, g, or t
  misc_feature (592)..(597): n is a, c, g, or t
  unsure (1)..(610): unsure at all n locations
ggctcctgacatgaaggtgaagtcgtcttccgctgtttntgtacgtgcactcgactaattcggccgattcagggttgcatcgctcacgcatggactaaaacgccagggaatgaatctaatattgtaagaacgatgggattgaatagcgcacgnctcgcacacatgtcagtcgttcatgtgacagagcttgcttgtacacntccattgacgtgcaagttattatcgtcatgaagaggcgctggtcccatgttaagttccggcacgtgatccgcgcacggccagccctgctgcacctgacctggcctgttgagtaattaagtcatcatcgctcacgtagagtgctcaagtaaaatactcctccctctgcccttcgnagccacaaattctaagcgacgcgaatcgcagccacacaccaccagcagcaccaagagccagatcagatcagcctgatgaactcactgccaccactcaaggcgcgcgggccgtaccaatgagcatcgtctgcccgagtagagtatacaagtattataagccggcgagagcataacgtcgcgtataaattaatattcatcgtacgatgccttgcgcgacnnnnnntgctacccacgcg

SEQ ID NO: 743 - DNA, 600 bp, Zea mays
  misc_feature (105)..(105): n is a, c, g, or t
  misc_feature (123)..(123): n is a, c, g, or t
  misc_feature (151)..(151): n is a, c, g, or t
  misc_feature (554)..(558): n is a, c, g, or t
  misc_feature (567)..(568): n is a, c, g, or t
  misc_feature (570)..(571): n is a, c, g, or t
  misc_feature (573)..(595): n is a, c, g, or t
  misc_feature (597)..(599): n is a, c, g, or t
  unsure (1)..(600): unsure at all n locations
acaccgaatgcacaaagcgttttcagagtccttgccgagtatcagttggcaaatgagaaggaggaaggtgagcttgttgtgcatatctttgctggaagagttggnatgttgcatactgatacnaaacttactttgtttctcaggtatgccngtcagcagtttgtatacaaaatgccgtgagcgctttctggtaagcagccaagtgacattgaatgcacacctgacggagtttaaagatcacgatctggttaagaccaggaagcactctgatgggcaagattgcctccgcattcctcttgtttctgacgcgctggagaagttgctgcaagaattggcttgacattttgcattagcgcatttatttttcatggatgatggatgggttcactgaagtatttgtagttttctctgcccacgtggaactgaaggatcttgtccttattgaaggaaaatgtattaccatggaaagaactcagatgagcatgccattgcatggattatttataactcggattccggaactgaaagcatgttgcatgaaccgctctgctttnnnnncttaaactnntnngnnnnnnnnnnnnnnnnnnnnnnncnnnc

SEQ ID NO: 744 - DNA, 605 bp, Zea mays
  misc_feature (6)..(6): n is a, c, g, or t
  misc_feature (82)..(82): n is a, c, g, or t
  misc_feature (133)..(133): n is a, c, g, or t
  misc_feature (154)..(154): n is a, c, g, or t
  misc_feature (307)..(307): n is a, c, g, or t
  unsure (1)..(605): unsure at all n locations
cggcgnggtctcgctaaccctagacaccagcgcagacccgccgctcggcgcctgccggttcatcgacgacgacgcgctcgancggggactcgccgccgtcgccgctagcttccccaacctcagccgcctctcngccaccgccgcctctgagtcnggcgggctcatggccatcgctgtcggatgcccgacgcttcaggagctcgagctccaccgctgcaccgacctcgccctccgcccggtttccgccttcgcgcacctccagatcctccgcattgtcgccgcgtcccccgcgctctacggcaccgcngagggcggcggcgtcactgacatcggcctcaccatcctggcccatggatgcaagcggctggtcaagctggagcttcagggttgcgaggggagctacgacggcatcgcggctgtggggcgctgctgtgcgatgcttgaggagctcaccatcgctgaccacaggatggacggtgggtggcttgccgcgctagccttctgtgggaacctcaagaccctgcggctgcagagttgcagtaggatcgacgacgatcctggcccagcggaacaccttggtgcttgtctcacgctcgagagcctgc

SEQ ID NO: 745 - DNA, 520 bp, Zea mays
  misc_feature (44)..(44): n is a, c, g, or t
  misc_feature (228)..(228): n is a, c, g, or t
  unsure (1)..(520): unsure at all n locations
ttgaagcatgtacattgcaaagatactactattaggtttagatnacaattaatagatttgtttgtgacaaaccgtgttttttgcatatccatacacatgacattccgtagtaaacatctctttagtttttccattcctacagctactaactatactactgcaatcagatagatggtcctactctagttacgcaggattaagtgatgcatagtattaatagcaaatagntggaacttggaaggttttgaacactcagctatgggtatggagaaaacatcttttcaaactgatgcttttgtatattcttatgtgacttgcttaaaatgcatgtcttatgccttattagtgatctcacaagatacctgatgcaaaaggtttccaccacaggtcatcatagatgaagctatcaccaaattggatgaggatttcttctggttgggtggcggagaagttgacctcaagctcggaatgcgaacctcacaattcttaagtgtctttagtccattcgtggtgaaatgca

SEQ ID NO: 746 - DNA, 507 bp, Zea mays
  misc_feature (5)..(11): n is a, c, g, or t
  misc_feature (21)..(27): n is a, c, g, or t
  misc_feature (42)..(42): n is a, c, g, or t
  misc_feature (216)..(231): n is a, c, g, or t
  misc_feature (262)..(263): n is a, c, g, or t
  misc_feature (333)..(348): n is a, c, g, or t
  misc_feature (353)..(353): n is a, c, g, or t
  misc_feature (355)..(357): n is a, c, g, or t
  misc_feature (359)..(359): n is a, c, g, or t
  misc_feature (363)..(376): n is a, c, g, or t
  misc_feature (380)..(445): n is a, c, g, or t
  misc_feature (451)..(471): n is a, c, g, or t
  misc_feature (473)..(486): n is a, c, g, or t
  misc_feature (488)..(506): n is a, c, g, or t
  unsure (1)..(507): unsure at all n locations
cattnnnnnnnctgtctaaannnnnnngcaattctaggtgcnttcttggttatagtgtctaaggtttgactaaatatatagttaaaaatattaatgtttgtgacaccaaacaagtatactatgaaaatatatcttatgacaaatccaatgatacttatttgatatattgcgaaagggcctctagctggattgattaggtggtctgagttttaggcnnnnnnnnnnnnnnnngggagcgaattttaggttggggctaaaaaannccccttgtccatcccacaccaaagcacaagtctaaggtccggccctggtcgtggtcgttctcacacaggnnnnnnnnnnnnnnnncatgngnnngncagnnnnnnnnnnnnnntctnnnnnnnnnnnnnnnnnnnnnnnnnnnnnnnnnnnnnnnnnnnnnnnnnnnnnnnnnnnnnnnnnntttttnnnnnnnnnnnnnnnnnnnnnannnnnnnnnnnnnnannnnnnnnnnnnnnnnnnnt

SEQ ID NO: 747 - DNA, 378 bp, Zea mays
ctgcgatgtttctctctcatcttttccttgtttttttttccacctttttatttgccttttcccattctctttaatctcgcctttgtatccatgtgcttggttctttgttgcactgcactgcagttgttgcaccataagaatccaaagtcctccacgctcataccccctctgatatatatgaatgcttgctatccatctcttcaatctcccatacatactacatgttcttgcttcgtagtagttgtcagttaccttaacaatcatcattcaggtttgcagtggtatcatctaacgatgagcaatatgtgtccatcaccaggggctagggctagggaagcccatggaggagatgctcatggctggaaacgcaaatctaaa

SEQ ID NO: 748 - DNA, 686 bp, Zea mays
  misc_feature (529)..(530): n is a, c, g, or t
  misc_feature (574)..(574): n is a, c, g, or t
  misc_feature (592)..(592): n is a, c, g, or t
  misc_feature (596)..(597): n is a, c, g, or t
  misc_feature (603)..(603): n is a, c, g, or t
  misc_feature (605)..(609): n is a, c, g, or t
  misc_feature (625)..(626): n is a, c, g, or t
  misc_feature (630)..(636): n is a, c, g, or t
  misc_feature (638)..(644): n is a, c, g, or t
  misc_feature (649)..(649): n is a, c, g, or t
  misc_feature (651)..(653): n is a, c, g, or t
  misc_feature (661)..(661): n is a, c, g, or t
  misc_feature (670)..(672): n is a, c, g, or t
  misc_feature (674)..(678): n is a, c, g, or t
  misc_feature (681)..(682): n is a, c, g, or t
  misc_feature (684)..(684): n is a, c, g, or t
  unsure (1)..(686): unsure at all n locations
atgcaagacgggccttgatgctagctagctagctccaatttgctggccttcagtcagcttaaacaggatatgagaatgtgggcaataatgatgtcccagtacgtgctatacatcagcaatttatttgcaacgtggcacaaagtagcccagtctagcagtatctaactccaattcacaaactggaattatatatatctacctgaaagtgaacgaacttaattatactagtctaatacgaggaacaaacaactggccagccgtatgtttatcaacgagtacggagtacaaataagtcagtaaaattgatggccgcccatcatcgttatatacatccctcggaagttttggcaactaactgcgctctcctcagtgttccattctaaaagaataaaatgcagtagcggtcctcaaacttgatatattgtgtcaattggatcatcgaactaaaaaaactagtaaaacgggtcctccaacttagtcggcccatgtaaaatcgtcgaaaaccggatttacttgaactagaagcatnncgtaacacattcgagcacacgtttgagtacccataccagactantcatgtttctatcatgtnttgnnactctntnnnnntcattaatggggtcgnnaatnnnnnnntnnnnnnncatantnnnatgaccgnaattactannncnnnnnttnnanca

SEQ ID NO: 749 - DNA, 377 bp, Zea mays
cgcagcctacagatccaaagctacgtactgtactctaaattccttgctgtagtacgtgaaacgtcatgcgtatccggccggctcccgcgagacaggaagagacagcgactcgcagacttgcagctgcccagcaggcagtagcttgccctttttaatcgcagcacttggggttgacagtcacacacacactggtcgcggcgcggcagatgaggcgccacaaatctgaaccagcatacagttagggcccatgatttcccccctttctctatggtttttatatataaaaaaactgatttatatgaaacttttgtatgattcctcctaaattcctgcatttcaaataagacatcgagctagtgtaagcgtaggcctgcaaa

SEQ ID NO: 750 - DNA, 323 bp, Zea mays
gtcggggaagtggtccactttggagacttcacaagcagcagtccgaggttcggtgcatattgggtcaataaagggcggatcgcgggtgcgtttcttgaaggcggaagtcgggaggagtacgaggccatctcgatcgctgttcggcgggaagctgtggtcacagacatgggtgaactcgagaaacaaggcctggcactcgccattcaggagagccagaaggaggtgcctgacagtgggcttgctgttgtcggaaaacctacttatgcgtggcatgccacagccggtgtcattgcagctgtgtcgattgctgcaattgggtattg

SEQ ID NO: 751 - DNA, 1018 bp, Zea mays
  misc_feature (10)..(12): n is a, c, g, or t
  misc_feature (41)..(46): n is a, c, g, or t
  misc_feature (50)..(52): n is a, c, g, or t
  misc_feature (249)..(250): n is a, c, g, or t
  misc_feature (447)..(449): n is a, c, g, or t
  misc_feature (463)..(465): n is a, c, g, or t
  misc_feature (501)..(501): n is a, c, g, or t
  misc_feature (503)..(503): n is a, c, g, or t
  misc_feature (508)..(508): n is a, c, g, or t
  misc_feature (636)..(636): n is a, c, g, or t
  unsure (1)..(1018): unsure at all n locations
gccgatgaannncggcgactgcaccgcaccgaccgggtcannnnnnagcnnncaaacggaatcgacaggaccagacgacccagatggtttttctgctaaccgcgatgaagaggtccctgccgagcagcccgtacgccatccagagcgcgctggacaggaaggagaagagcgagagggagaacggcatgaactccacgctcttcgtcgcgatgactcgcttctgcatgcagtagcgatcgacagggggtnntcgttgggctccagccagagattttagtgccagcagatgctgtgaaataaagtgcatgggaaatcagcaggggggaggggggttgggcgatcgatagatactgacagcggccaccattggagaggtgtacatggacacggaagccaccagcccgacgctgcccacgaacgccttgcgcgagcggtgcgtgcgcgccnnnaagctcgacaaggnnnccgtcaggccgaacagcgccagggcaggaagcaccngngtatntgtcaatgttcacttctgtttgaagtgcgcgagaccagtgctttactttcctgacccgtcggagtatcggtttagcaacttcaggtactgggctttgttgtgaacaaatagtgcaatgtaactgaacntgaacctaattgaatttctattagattggatggtcatattgcaaccatgacatgttggtctccttgaattttactgttacatggatgcatcgagcaaattggtttgtgttgatacttgatagcatgcgtatgaagagcaagactgcaagggcatgtagcatcattgcattttaaccctgcccttgcctgtcttatccgagctgttctaaaacaagctatttttcaaggataatgccgccggatagtagagagagtaaattctagtatcaatgtggttctttttttttttgctgttgctgctggatggtatattttagtgtcaaagcggtctttttttggtccttggctcggagtttaggcttccaggaatttgaacttgtca

SEQ ID NO: 752 - DNA, 582 bp, Zea mays
  misc_feature (71)..(71): n is a, c, g, or t
  misc_feature (87)..(87): n is a, c, g, or t
  misc_feature (100)..(101): n is a, c, g, or t
  misc_feature (182)..(182): n is a, c, g, or t
  misc_feature (187)..(187): n is a, c, g, or t
  misc_feature (212)..(212): n is a, c, g, or t
  unsure (1)..(582): unsure at all n locations
aagactgacgactaacgattagataggttgacggagactttggggcgagtaccgtctcctcctcctggttnctgctcccattcctanggtagcgtcctcnnagctctgcgagcggcggcggctagaacttcttgttgtaccagaagacgcccttgcggtcctcgggctcgacgtagatgcantcccnggcctcgcgccaggtcgccttggcnacaggggtcgggtcgaagtggtagtagtccccgaggatgggcctgatcgccttggtggcctccatggcgtggtagtgcggcatggtggagaagaggtggtgcgcgacgtgcgtgtccgtgatgttgtggaacacgcggttgaggatgccgtagtcgcggtccatggtggccagcgcgccgcgcagccagtcccactcgctcgagtcgtagtgggggagcgacgggtgggtgtgctgcaggtaggtgatgagcaccagccacgcgttcacgatcagcagcggcacggcgtacacgcgcaccacccaccagaccccgaacgccgccgccagcttgtacagcccgaacgccacggccacgacgccggcgtccg

SEQ ID NO: 753 - DNA, 558 bp, Zea mays
  misc_feature (23)..(23): n is a, c, g, or t
  misc_feature (48)..(48): n is a, c, g, or t
  misc_feature (53)..(53): n is a, c, g, or t
  misc_feature (137)..(138): n is a, c, g, or t
  misc_feature (148)..(148): n is a, c, g, or t
  misc_feature (164)..(164): n is a, c, g, or t
  misc_feature (365)..(365): n is a, c, g, or t
  misc_feature (503)..(510): n is a, c, g, or t
  unsure (1)..(558): unsure at all n locations
accacttcgacccgacccctgtngccaaggcgacctggcgcgaggccngggantgcatctacgtcgagcccgaggaccgcaagggcgtcttctggtacaacaagaagttctagccgccgccgctcgcagagctgagnngacgctaccntaggaatgggagcagnaaccaggaggaggagacggtactcgccccaaagtctccgtcaacctatctaatcgttagtcgtcagtcttttagacgggaagagagatcatttgggcacagagacgaaggcttactgcagtgccatcgctagagctgccatcaagtacaagtaggcaaattcgtcaacttagtgtgtcccatgttgtttttcttagtcgtncgctgctgtaggctttccggcggcggtcgtttgtgtggttggcatccgtggccatgcctgtgcgtgcgtggccgcgcttgtcgtgtgcgtctgtcgtcgcgttggcgtcgtctcttcgtgctccccgtgtgttgttgnnnnnnnntaaaacaagaagatgttttctggtgtctttggcggaataacagatcgt

SEQ ID NO: 754 - DNA, 722 bp, Zea mays
  misc_feature (172)..(172): n is a, c, g, or t
  misc_feature (178)..(178): n is a, c, g, or t
  misc_feature (204)..(204): n is a, c, g, or t
  misc_feature (280)..(280): n is a, c, g, or t
  misc_feature (304)..(304): n is a, c, g, or t
  misc_feature (459)..(459): n is a, c, g, or t
  misc_feature (488)..(488): n is a, c, g, or t
  misc_feature (581)..(581): n is a, c, g, or t
  unsure (1)..(722): unsure at all n locations
cttgatggaatcatagagcccaaagtacagaccacgataaacaatgattccaacacaggagatgttaaatccacggtaaagcccagcaataccatcagacttgagtgtcttgcggtagacatccacaagcccattgaactgcctttcacctcctcccttggcagccttcgcntcattngccaaccttgttctcgcgtagtccanggagtacacaaaaaacaaagaggaagcaccagcagcaccaccagaggccaggttgccagcaaaccacttccaatanccatccctatccttcttgaagttnaacaacctcttgaagtagtccttaaatgcaaagttcaaagcctgggacaaagatttgaagacaaattaataatgtacaagttaaagtgtagtcggtaacttgtataccttgcaaagccaccaggaacattcaaccacttaggtaagaaagatcanggtgtttcaacatatttacagatgttacngagtaaaaaatatgatggaaggtgtgggctacctgagtagggaagtaacgaataacattagcagtgttacccctccacaaggaagagaaaccntcatccttaatggtacgtttgaagcagtcaacaatacccttgtacggctctgatagcctaccagacttaatcatctcatcttggttctgaataagcagcttcacacgctcgatgggagcagcagcagtcttcgaaacagca

SEQ ID NO: 755 - DNA, 776 bp, Zea mays
cggtcggaaaaatgtcagaagggcttccagcaggcaacaatgtagatagatgaatatgacacatgaagtcaaaatcaagactctgtaatagcagaaatggacaaggcttttatatgctgggcctgggcttcttcataaaaggttccaattcaccaccgtccaagtataacttgatgcaattggcatctcagtataacatgatgctgagcctcctccacaaggctaagtataccatgatgcactcagcactcctctctacttggcatgtctcgatcaacttcaatcctggctaaaacaggagaagtatcaaagcttcaaactccttgctaacagtcctaccaattgaagtataatgactcgaggactatacggatagctcttatgagagttcctgcattcctggttgttagccactagtcacgtaaaaaaatactctgctcgcccactccccttgctatgatcttagtaaataagcttgttctgaccttacctttcattcgtgctcccttcatataaatcattttggcttatctaagtacatagcttttgacatgtatctagacaatagcgtagtatctaggtgcataataaaaaggcatgtatctagaaacaccaaaacagcttatagtttggacaagagggagtagctttgagagcgatactatcaaataaacacaatgtaactatcctacctagagaatatgctggaataaaggaatccaccatgggggactgatcttaccttaagtaaacatggaaaccaattgatcgtattg

SEQ ID NO: 756 - DNA, 690 bp, Zea mays
  misc_feature (49)..(49): n is a, c, g, or t
  misc_feature (98)..(98): n is a, c, g, or t
  misc_feature (143)..(143): n is a, c, g, or t
  misc_feature (478)..(478): n is a, c, g, or t
  misc_feature (480)..(480): n is a, c, g, or t
  misc_feature (547)..(547): n is a, c, g, or t
  misc_feature (587)..(603): n is a, c, g, or t
  misc_feature (605)..(611): n is a, c, g, or t
  misc_feature (614)..(618): n is a, c, g, or t
  misc_feature (620)..(638): n is a, c, g, or t
  misc_feature (640)..(641): n is a, c, g, or t
  misc_feature (646)..(658): n is a, c, g, or t
  misc_feature (662)..(668): n is a, c, g, or t
  misc_feature (671)..(675): n is a, c, g, or t
  misc_feature (678)..(680): n is a, c, g, or t
  misc_feature (683)..(687): n is a, c, g, or t
  unsure (1)..(690): unsure at all n locations
agactttgaaagaaaaacggaggcgtgctgtgcaattctcaaaggctgncctggatgttcctgaagaactctcactgttcaagaaaagcggtggtacnaaagttcctgaaaacagtgatgctggggagcaagtttccccattnaagtttgttgagccagcaccaattgtggattctggtagagaatgtaataacaaaatgaaggatctagtgaaagctattgaatgccaaccgattatgggttttggagctggcattccagagccagaaactgaagagcctagtgatgatgctcatatgttgacaaatcagaaaattcagttgtcaattccaagttgttctggagcagaattagatttgcaggtcatcaatctgatccgaactatatacttatctcattttctgcatgctcatcaatgtttagattattcaaaagaatgctagttccgcctatccgtagtcctttcctgatgctatancngaacctgctatacttattttaatataatccattgatcgtagttattctttttttggtagggtaaagnactaggacaagggcagcattctgtacaggagtgcataaannnnnnnnnnnnnnnnncnnnnnnnagnnnnnannnnnnnnnnnnnnnnnnnanngatcnnnnnnnnnnnnngatnnnnnnngannnnntgnnngcnnnnnatg

SEQ ID NO: 757 - DNA, 535 bp, Zea mays
  misc_feature (34)..(34): n is a, c, g, or t
  misc_feature (70)..(70): n is a, c, g, or t
  misc_feature (112)..(112): n is a, c, g, or t
  misc_feature (130)..(130): n is a, c, g, or t
  misc_feature (154)..(154): n is a, c, g, or t
  misc_feature (185)..(185): n is a, c, g, or t
  misc_feature (193)..(193): n is a, c, g, or t
  misc_feature (196)..(196): n is a, c, g, or t
  misc_feature (275)..(275): n is a, c, g, or t
  misc_feature (313)..(313): n is a, c, g, or t
  misc_feature (351)..(351): n is a, c, g, or t
  misc_feature (356)..(356): n is a, c, g, or t
  misc_feature (484)..(484): n is a, c, g, or t
  misc_feature (507)..(507): n is a, c, g, or t
  unsure (1)..(535): unsure at all n locations
gctcgcaccgtctttgataggtaaactgtgcaanggaagctgccagttatgacgagagaagaccgggctnacgtagcagtagacttggtcgttcagtgggtcatagtacggnttcggatcttccaacggngcagagaaggtgcagagggaactngcatacttcaaaagccaccctggctttacgntcgttacnccntgcatgtatagcctctttgtactaagtagctccgagtaaactacaagctctggggcaacttgggcgacagatgatgatnggtgcagatatattgtatcatcaagtgcacaagactgntaacgaacggctcgaacctttcgatcgtcttctgatgntttcnaataggtgtgaatcctccttgcaactctatcagcccatccagcgcaaattccttgcccaagaagttcctcttcattcaactgcaatatactgggctcgttcctccaggcccgttcaacctcagcagantcacccgaattccaagcaaactnctcgcaccatttgctatggcgaaatatt

SEQ ID NO: 758 - DNA, 665 bp, Zea mays
  misc_feature (55)..(55): n is a, c, g, or t
  misc_feature (102)..(102): n is a, c, g, or t
  misc_feature (140)..(140): n is a, c, g, or t
  misc_feature (172)..(172): n is a, c, g, or t
  misc_feature (181)..(181): n is a, c, g, or t
  misc_feature (226)..(226): n is a, c, g, or t
  misc_feature (234)..(234): n is a, c, g, or t
  misc_feature (337)..(337): n is a, c, g, or t
  misc_feature (377)..(377): n is a, c, g, or t
  misc_feature (382)..(382): n is a, c, g, or t
  misc_feature (391)..(398): n is a, c, g, or t
  misc_feature (414)..(414): n is a, c, g, or t
  misc_feature (416)..(416): n is a, c, g, or t
  misc_feature (435)..(435): n is a, c, g, or t
  misc_feature (444)..(444): n is a, c, g, or t
  misc_feature (452)..(456): n is a, c, g, or t
  misc_feature (475)..(475): n is a, c, g, or t
  misc_feature (493)..(493): n is a, c, g, or t
  misc_feature (544)..(550): n is a, c, g, or t
  unsure (1)..(665): unsure at all n locations
caaatgtgacactatttccttccaaacacaaaatggaaacgtaaaggctcaactncttcacgtcttcttctggtctctggccttgcattagtagtagtgtgntactacaataatgaaacaaacttggtccttcctccagntccagtcaaaaactgtgttctcaactttgaanttttaaagnggcatggcatggcactggcctgacagacggcggaatggacatgtnttctcttncgtccccgaagcgccaagaagattcaaaaccggcatgcaaatcgtcagaaacttgcagcaacgctttattctttcctgctgtatgatttggttcatacacttntacagacttcattcagagcagcactgcaaaaatggccatnagccnatgaccaannnnnnnnggaaggggcaaggggngnagcaaaaggatgttccccnccaccacgnaaaaaaannnnngaggagttcctaaattaanctaatcgcgtccgtgtancttttatccacagcttaattcatgacctaatctacgcacaatgttcatgannnnnnngaagggtctcttgagccccttgaaatctaccgtctcaatgcactcaacgccgtctctcgacccattcaggagcctgagcagctcgctggccctctccttggtcacgcccatgcag

SEQ ID NO: 759 - DNA, 713 bp, Zea mays
tacccctgaaagtggactcagatacctgaaacaaaacgaatatatacaaacatacgaactcaagtgagaaagagtaatgcttcttctgcaagattctttcttgcttgagtaccccggagcagatactgaaattaaaaatacagtaactaatctgttcatcttcctacctggcaacattacgccaaaggccactgaagccaactataatctgtaaggctgaagccacaatcaacgcaccttgtgtcccacgcatgatgcggagaaatttcttcggaatataacaagcacatcatcaggtccaggtgtacacaactaagtgagatcagaaaaatgggagatggtggtacttccgacatacaatatgtggattaggttcattagcataacgtccagcaaggatgatcgaaatggtaggcagaacaaaggtgtatgacccgccgatcactgcaggcaacatggtaccaaagaaactctgcaggagggtgttgatacctgcaacgaacagcaatgtctggataaccactgctttgtcctcctaccacaaggaacagtaggaattagattgatagcttagaaccatgtaaccaacaaaatatgaatagtgaaatttcaaatctcacattgtttcctcccatttgtggaacaagtgcagttggtatgatcacagtggtaccaagcatgaccagataatgttggaacccaagaagaacggc

SEQ ID NO: 760 - DNA, 842 bp, Zea mays
  misc_feature (14)..(14): n is a, c, g, or t
  misc_feature (64)..(64): n is a, c, g, or t
  misc_feature (298)..(298): n is a, c, g, or t
  misc_feature (478)..(478): n is a, c, g, or t
  misc_feature (535)..(535): n is a, c, g, or t
  misc_feature (600)..(600): n is a, c, g, or t
  misc_feature (627)..(627): n is a, c, g, or t
  misc_feature (761)..(761): n is a, c, g, or t
  unsure (1)..(842): unsure at all n locations
tgttgccgagacantggtcttgattggaacacctagtttgctgcacaaatatattacattacanaatgaggcaaatatatattacattacataacaaggcaaataatatcgagtaaagcagaatagcagatatatcatctttaagctacctaaacagagcagcaaacactgtatttacagtattgagacttgataggtccagctccagttcctgactatctgcttcaatggcctggacagtaacaaaaacattagtcacacgaaaaaaaacagtcagctcaaatgctcaaccatgccnccaatcacctcaaaccctgatgcatcatactggcgcctcttgtctggatctgacaggatattataggagaatgtggcctcttgaaacttctctgaggcaacagggtcgtctgaattcttatctggatggtacctgcatgacaaattttactagatatataaatactcagacagctgcatngtcaccatcaatttatcagtaaacaagatagctaaacagtctaaactaccaataacntacacataaggcaggacagagcttcttttttttctttgcaagacagagccttgcttgttgttccnatttataatgcacgattcagaagctanataatactggtctttacgtggttccaaaaggagaggaatttattcaagataataaaacaatatacagctacgcatactcggaacaaaataagcacaaaatgcgaactaatctacaaaaggaatttgaacacagncattccctctgaggaaaataagagcacgcgaagtgcccaaatccaagaccattgcagacaatacttacttgagtgccatgc

SEQ ID NO: 761 - DNA, 615 bp, Zea mays
  misc_feature (187)..(187): n is a, c, g, or t
  misc_feature (380)..(380): n is a, c, g, or t
  misc_feature (442)..(442): n is a, c, g, or t
  unsure (1)..(615): unsure at all n locations
ctctaccagaagcaaagactcgctccgcccgcccatgccgttcacgaggacgtcgaccgtgcgcgctttggacacgatggcagggaagaattccgtccacttgctctgcaagaacaatgacgaccgtgcacgtcacgcttcacgacgacgtggtggtaggtgcgaaccgtatgtaaatagtgctatntattttactcctattaattgcagccatgaactttaccgagtccatgaacatgtcgacgaggccgatggcgctcatgaagacgagccccgtctcgcgggagccctcgacgtgcacgtccgggccgcggaacgagccgtcgggcttggcgaagatgctgtcgtacgtgtcgacattgagcacctcgcggccgccngtcttgacccacaggtgctcgccggcctgcgccatcctgatgagctcgtccatggcgcgcgncgccatctcggccatcatgggccgctccatctccgacaccgccatcgggaggaggtggaacgggggataccccgaggagccgccgctgaggaggtcgaggtccagcgacgggccgccgagcccgccgacggacaggtccagcgacgacatggacagcgcctgcgccgacggca

SEQ ID NO: 762 - DNA, 466 bp, Zea mays
  misc_feature (34)..(34): n is a, c, g, or t
  misc_feature (354)..(354): n is a, c, g, or t
  misc_feature (440)..(440): n is a, c, g, or t
  unsure (1)..(466): unsure at all n locations
taacttgtattttggcagtacagcctgattcatntcaagctccatacttacttcataataacgacgaaaatatgaagcgtcccccaaaacccctggatttgtgaaattcaccattgaaaagaattcttccaaatcattctgcagcaccagaaaacattgagtacagcaaattccaagtcaattgttctaggataagcgtgcaattctattttgtggtaggtaggtggagggagaccaaaatgtacctgcattggggtaccggacaaaagaatacgccgtgtacatggaagggcagccaaagcctacacattatgcattttaacgtttcagcagaacaaagccagagagggaccncaagtgtagatgaatagtgtgtgtaaatgacatcagtaaactgacggaccttatttgtcagtgtctgatcatttttcagcctgtgngcctcatcacatatgagaaggtcaca

SEQ ID NO: 763 - DNA, 740 bp, Zea mays
  misc_feature (712)..(715): n is a, c, g, or t
  misc_feature (726)..(727): n is a, c, g, or t
  unsure (1)..(740): unsure at all n locations
aggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggtactcatgccttctttttttccttaaaaaaatggatcggtatttacaatgaatatgtttgactgtcacttgttttgtttatttatggtgctgcaaaatggctatgcattaaagatgaatgccctgtgctatctgcaggatcaatgcgctgtttgaccacttcaagatggccctggattgtttctttgccgtctggtttgttgttggaaacgtgtggatatttggtggccgttcttctgctgctgatgcaccgaacttgtacaggtaaatgtgaactgctcttcaattgatgagatgtcactatgtcagnnnntttatcctgcnnctgactttctact

SEQ ID NO: 764 - DNA, 931 bp, Zea mays
  misc_feature (5)..(5): n is a, c, g, or t
  misc_feature (10)..(10): n is a, c, g, or t
  misc_feature (34)..(34): n is a, c, g, or t
  misc_feature (104)..(104): n is a, c, g, or t
  misc_feature (109)..(109): n is a, c, g, or t
  misc_feature (193)..(193): n is a, c, g, or t
  misc_feature (207)..(207): n is a, c, g, or t
  misc_feature (220)..(221): n is a, c, g, or t
  misc_feature (223)..(228): n is a, c, g, or t
  misc_feature (263)..(263): n is a, c, g, or t
  misc_feature (358)..(358): n is a, c, g, or t
  misc_feature (378)..(378): n is a, c, g, or t
  misc_feature (409)..(409): n is a, c, g, or t
  misc_feature (423)..(423): n is a, c, g, or t
  misc_feature (428)..(429): n is a, c, g, or t
  misc_feature (437)..(437): n is a, c, g, or t
  misc_feature (490)..(490): n is a, c, g, or t
  unsure (1)..(931): unsure at all n locations
cattnacaanagtagaggttagcagcacataaanggacaaatcgcctgcataggaacataatatctacagtagatactatattgtgatgctatcatatagacanacaancatacccattaatatcatgatgcattattctgcctatctagagtaagtagtcatctcatgtaataagggtgtgttgggtttgcnccctcctaggagtnacagcagccacanngnnnnnngcatccaaaatcggacgcttgggatctctgcctgngcaagttatattgagtgataatttgcttcacactatcggcaaattcatagcagatagtagatcagaagttctttgaagtggagtagaaggcaacntactacacaatattaattgnttttcctctagctaagcaactagtcaagtgngtagccgaaaaaanggtgnnaataaaanctaacaaaaacccgcacctgtcaagacggcaaatgggagatctggaagctttnctgagataacgctttacagaatgagttaaagttgggtcattttgcttgtgtgttaagggtgtgtgtgtgtgttctattagttcatagttattaccccattttccttcttaatataatgaataatgatacatggctctcatttgtgtttgctaaaaaaagtggcaaacactataaaaatatagatggacattaagcattagaagaacactggccatgtggagatggtcgaatggaaagaaatgatacaaaagttggaacatgtcaatttgacagatggtctgagatcaagtgctagctagaaaaatctgtgaaattcagtacaagatcgttgtatagagacagagttatgacctttggaaggtagcaatcaataaatgatggggtagaggactaaaattcccacgagttctaaattttctaaccgtctttcatgataaaatt

SEQ ID NO: 765 - DNA, 471 bp, Zea mays
tgcgcgcaccggtcgcgccaccggcgtcgcagctcgtcagcctcccgcgccttctcctgaaaaagaaggcgatagtttccacgtgtgtcagatcgtacgctgcagccacgcacgacaaataggagttgtgggacgtgtgcgtgtgcgcgacacgacgtgctgcgactgcaacaacgataactaattaaccgacctgcgcgcggtcggccgggcgtccgctgctcggcgtcccgatctgcagccactgcgacatcggctgctcggccggacagggagcacgctcggatgaagccatctcggcgcgctcgcgctcgtagccctctgcgcaggcgctgcaaaggctcggcgcccgttgcattggggacgtcatcgccgttgacagcacctccacagagctgctcaggatgcccctgttaactccagcactgtcacatcaggaaaacaaacaaacataggaggattcagtgagca

SEQ ID NO: 766 - DNA, 601 bp, Zea mays
tgaacccgaagactaaagttgtctttgcttatgctattatgtacagtggtcatagctgactattgtgaattgctagtcctatttggttcgtgatggaggttacgagtcacaacatggtatggtgaattgaacttgggttgacggtgccatctgtggatgtgaggaaggtagcttgaatctcaatcagagcccatctgtggatctgaggaaggaaaactcagaatatcaatgaaagcgtaatgaagcttctgactggtatatagactgaatggttgtaagttaactagttgctacgttcatgttgtatattcagacatctctgggcctatagatttcttgaaaaaaaaaggaaagaaaaaacaagaatacatcattacatagactgtaatcttaaacatctgacatgaagggtgtggctacgttgttcgtggccgtggagaactgtaaatgatgagggtgtggcttctggtaaaatggtcagaaccaggcagtggtgacagatatctcgttgcattgagtcatcagggcgcagattcgaacaggtgcggagctaggccgcggattcgaacaggcgcagagctaggcctgtttatcggtgtca

SEQ ID NO: 767 - DNA, 630 bp, Zea mays
  misc_feature (6)..(6): n is a, c, g, or t
  misc_feature (46)..(46): n is a, c, g, or t
  misc_feature (56)..(56): n is a, c, g, or t
  misc_feature (101)..(101): n is a, c, g, or t
  misc_feature (129)..(131): n is a, c, g, or t
  misc_feature (139)..(139): n is a, c, g, or t
  misc_feature (244)..(244): n is a, c, g, or t
  misc_feature (295)..(295): n is a, c, g, or t
  misc_feature (319)..(319): n is a, c, g, or t
  misc_feature (348)..(348): n is a, c, g, or t
  misc_feature (387)..(389): n is a, c, g, or t
  misc_feature (406)..(406): n is a, c, g, or t
  misc_feature (410)..(410): n is a, c, g, or t
  misc_feature (426)..(426): n is a, c, g, or t
  misc_feature (434)..(435): n is a, c, g, or t
  misc_feature (443)..(443): n is a, c, g, or t
  misc_feature (445)..(445): n is a, c, g, or t
  misc_feature (455)..(456): n is a, c, g, or t
  misc_feature (461)..(461): n is a, c, g, or t
  misc_feature (491)..(491): n is a, c, g, or t
  misc_feature (500)..(500): n is a, c, g, or t
  misc_feature (502)..(503): n is a, c, g, or t
  misc_feature (522)..(522): n is a, c, g, or t
  misc_feature (539)..(539): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (558)..(563): n is a, c, g, or t
  misc_feature (565)..(629): n is a, c, g, or t
  unsure (1)..(630): unsure at all n locations
gttggngctgagaacaacctactgctgctgcactcaaccacggccntattagaaancttgggaccagtaagataatcaatcgacaagctatatatgctggnagccaagaagacaagtattagtagtagnnncagtagangaccatgcttgtgaaaccactactgctgctgcactcaacattagatcttctgaataggtaggatccttcagggtttcattctcaaaaatctcaatagctaaacangtctgtgctgactagtacataaatataagaaaatatgctggatatttttcngttctcatcagttatgctggttgnaaaattttcctcgcacaactggaagatanttctacaccaacttcatggactcattctcattatatctnnnaattcaaaagctttcgngggnggaactcccctcaaancgtaaagnngtaagggntngtttgatgannagggnattcaagtgaattgaatagcaagagatttncttggtttnannagcaagaggattcctctcntatggatcccttcaatncncngntcaccaaatcagnnnnnnannnnnnnnnnnnnnnnnnnnnnnnnnnnnnnnnnnnnnnnnnnnnnnnnnnnnnnnnnnnnnnnnt

SEQ ID NO: 768 - DNA, 727 bp, Zea mays
  misc_feature (42)..(42): n is a, c, g, or t
  misc_feature (148)..(152): n is a, c, g, or t
  misc_feature (154)..(155): n is a, c, g, or t
  misc_feature (277)..(277): n is a, c, g, or t
  misc_feature (380)..(380): n is a, c, g, or t
  misc_feature (437)..(437): n is a, c, g, or t
  misc_feature (553)..(555): n is a, c, g, or t
  misc_feature (557)..(557): n is a, c, g, or t
  misc_feature (581)..(582): n is a, c, g, or t
  misc_feature (585)..(586): n is a, c, g, or t
  misc_feature (614)..(615): n is a, c, g, or t
  misc_feature (625)..(626): n is a, c, g, or t
  misc_feature (640)..(643): n is a, c, g, or t
  misc_feature (645)..(645): n is a, c, g, or t
  misc_feature (651)..(655): n is a, c, g, or t
  misc_feature (657)..(662): n is a, c, g, or t
  misc_feature (665)..(665): n is a, c, g, or t
  misc_feature (667)..(667): n is a, c, g, or t
  misc_feature (669)..(682): n is a, c, g, or t
  misc_feature (684)..(684): n is a, c, g, or t
  misc_feature (687)..(725): n is a, c, g, or t
  unsure (1)..(727): unsure at all n locations
gagcagcacgtacaactcaacaggcaaacaatccccattcanctgcctgctttccttagtcccttccttcctcatcgacgaccagtgacatcgctccttcgacttgcacacggcacgagcagcagcaaagcaatgcaatgcaatgcannnnngnngggttagtgactggcgtacgcagctaaagacggccgagacccgcatggcctcgccgccagcctcatctcttcccgaatctcaagcacttggtgcgtcttacttcgtcggccatgctcgacgncggcggcgccctggccgccttgctgtcctttgccagcttctccatggcgtttatgaacttgcgcaggtgcctgatgtactccgggtacgtctccaggttgcantgcccaccgcctttgatccacagcggctcgtacttctccttggctagctcccacagncgcttgccatgcgtgaagtccacgatctcatcggctgtgccctgccatgtatgtatatacgattcattcacgaagtcaagacacaaacagttggaactgctactacttggtagtgnnngntcttcagaatcttaaaattaaacnngcnngaagaacaagctatttattacaagtgannattattcgcnngtcaaaacagactnnnnanacaccnnnnnannnnnnaantncnnnnnnnnnnnnnntngcnnnnnnnnnnnnnnnnnnnnnnnnnnnnnnnnnnnnnnnct

SEQ ID NO: 769 - DNA, 460 bp, Zea mays
gaagagctgtatagctggaaggacccaaaaatcccagcctagcgtccacggaactaaacatcaatagcttgaccctcaactatcgtacctcagcctagttcacattatggaaggaatcgatgatggcgtcggcaagataatcacacttagccagggacagcccagctaaggagatccgcccatccttggtcatgtaaatatgccatttatccgtcatgttgtcactctgcagccgaaaaagcgaaattatgcatttacgttatttttttgtagatgatatgtatgtttcaacaaagagtgtgtgaccggtgattgaacttgatttagcgtgtgatgtctgcacaacggcacaagcggaagcagcattacctgtgctttgttcaagccggtgtaggagaacatgccaatctgcctcagaatgaaagaccagtccttgccgctcttatccttggcagacatg

SEQ ID NO: 770 - DNA, 571 bp, Zea mays
cgcatgaggggagagatggaccaggtgctccttcctacgccattgccaacttgttcttgttcttcttcttcttccattatattggcggcttgactgaaacgttaatctgcttgcaggtccggagcgtgatgatggacaacatcgacagggtgctggagaggggtgaccgtctggaggtgctggtggacaagacggcaaccatgcaggggaacacggtgcgcttcaagcgccaagctcgccgcttcaggaacaccatgtggtggaggaacgtcaagctcacgtacgccatgttcttgttgttgtcttgcacattttagggtaacaatcgcctgtccctgtaactcttccactggtctttttgcagagctgcagtgatattcatcctcaccgtaattgtgtacgtcctgctcgcctacatgtgtcgcggcttcaccataccgtcatgctttccgtaatctccatccgtcccggtgccagtgcggaccaccagccctagctctagctgcgtcacaacttggttttccgggttctgtaacagcagcagcggtgctgcagttctctctcttgtacg

SEQ ID NO: 771 - DNA, 653 bp, Zea mays
  misc_feature (52)..(54): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (220)..(220): n is a, c, g, or t
  misc_feature (222)..(222): n is a, c, g, or t
  misc_feature (226)..(227): n is a, c, g, or t
  misc_feature (244)..(244): n is a, c, g, or t
  misc_feature (253)..(253): n is a, c, g, or t
  misc_feature (405)..(405): n is a, c, g, or t
  misc_feature (559)..(560): n is a, c, g, or t
  misc_feature (589)..(599): n is a, c, g, or t
  misc_feature (603)..(604): n is a, c, g, or t
  misc_feature (606)..(607): n is a, c, g, or t
  misc_feature (614)..(634): n is a, c, g, or t
  misc_feature (638)..(649): n is a, c, g, or t
  unsure (1)..(653): unsure at all n locations
tgcaggcagttgaatggaaaataccagtaaaggtataatccagaacttgttnnnttaaaaggattgaaactggttagtccntnaaacaaaantgggtgtatctttttttcattcatcttgaatttctttaccaacaggttaggggatttgaaacccaaatggagaagtggatgggagcttgtgattgcattataacaaaggtatatcctcctccattatngnttcnnatcatgtttcttctttngaaggtttntgtgggtttcctaattttgtttctcttctgttatggtttcttaggctggaccaggtaccattgctgaagccttgataaggggtcttcctataatccttaatgacttcatacctggacaggtttgtgttcctacgattattctgcactcatgnagttttattgccataatgtgcatgtgaagtgtatgtctttttctgcatttctgatctccttaataaaagggtcttagtgtgtaacgtgtttggatcatatgcgctacttatatatttgtattttgattgaatgcaatatatatgaattaaaggnnattctaatgtgttaacatgttctcacatnnnnnnnnnnntttnngnntgtatgnnnnnnnnnnnnnnnnnnnnnttannnnnnnnnnnntggt

SEQ ID NO: 772 - DNA, 777 bp, Zea mays
  misc_feature (279)..(279): n is a, c, g, or t
  misc_feature (293)..(294): n is a, c, g, or t
  misc_feature (327)..(327): n is a, c, g, or t
  misc_feature (331)..(331): n is a, c, g, or t
  misc_feature (408)..(408): n is a, c, g, or t
  misc_feature (464)..(464): n is a, c, g, or t
  misc_feature (486)..(486): n is a, c, g, or t
  misc_feature (651)..(651): n is a, c, g, or t
  misc_feature (694)..(702): n is a, c, g, or t
  unsure (1)..(777): unsure at all n locations
ggtacccctggcaacatcttcttttgatagaactattaaattatggaatgctgccgatgtaagttagtttgcttatccattataggggccgtagatattatgctattatccatcctatagtaatgttaccattatcctactgcatacttcactagtgcacctgcatgctattaagatatggagtgttttttagtattcatggctgcaaatctagttatacttatccatattgtcaccatgtttcaaaatgtagcaaggcccaaccatgacatgattgantttgcatgtaaagnncattttttttcttttttctgttttgatctgcanattntgttatattatgaaaatcctacttaaatgcagcaatatattgggtgaactgtgccatctgtgttactaaccttgaancttaagcctcagattttttgtatgcacttgcattacagcatttcttatgctcacangttttgcagcctggattctctntgcatacattcactgggcacaacggccaggtcacatcattagattttcatccaaagaaaacagaccttctatgctcttgtgatggcagtggtgaaatccggtactggaatgtgacccagtttgcatgcttgcgtgccataaaggttgcttatattccttctactntttgaagtttcatgactgagcgtgcaaaaagggtctgaatttnnnnnnnnntccaattctgcctttctacagggtggtagtgcccaagtccggtttcagcctcatgttggacagtttttagccgca

SEQ ID NO: 773 - DNA, 996 bp, Zea mays
  misc_feature (296)..(296): n is a, c, g, or t
  misc_feature (991)..(995): n is a, c, g, or t
  unsure (1)..(996): unsure at all n locations
agtttccacgagttcctgatcctgaacaacacccaacaccacattcactaccgcaacccctgctccccttctcccaccacccagggacatagcccagtgcgacatcaaactcgaacgttgtcagcactggcttcttgaaaccctccccccagtcgatcgacaagcgtggacaagcaatttgcacccaggcatcaatggaatctccaaatagctccatcctcgccggggaaagctccgacatgagcaccactgtgtgttccaactctttctcctccaaatgctccaccaccctgtcnagaaccttggtgctcccctgcctccccagggtgccaagtacgactccccagctcttggccttcctggccgccagcaccgccgctttcctcgcctgcttcatgccaacatggtcatactcctccagcacgagaaccccgaggaatgggtcgaaacggtaggccttcaccccgggattggcgatcataaacgcctcgaggtggaacctcccgtcggcgacgaacaccacggcgcccacctcctccgacttcttgagcgtcggggcggtgcaacccaggatctcgccggcggacagcggcttcgcctgcggcacgacgatgtcgtggtagccctctaccgtgagcatctcgcgcgcggcgtggaccgcggcgatgaactgcacggtcccggcgatggcgaggcggggcgcggccgctgggtccgggaaggcagctcggacggcggcggcgaggcgggcggcgtccacgcggatctcgacgaagacgtagagcaccgggaggagtgaggccgtgacggggacgaggcaggagtggccgtagtggacgaggaggtcggcggcgagcgccctggcggggcggtcagcgaggcagcaggccccgtaggtggcgtcggcgaggacgaggacgtcgttgtcggcgccgggctcgaggtagggcgcgaggaggtgcgacagtgggagcgcgaagaggagcaggcnnnnng

SEQ ID NO: 774 - DNA, 539 bp, Zea mays
tatatagagtagtgcttgtgaagaaaaaaaatacggatttcgaatatattacaaatgcagcaggcttatgctgctctaggatggatggtttttctgcgcctctacttcgcatccttagacagaaaattatgtgcctgcatgtccctcacgttggagagtccatccaccgcgtctccccgctcgaacacagctgctgcccccattccagatcctgcaattgtcacgatgcatcacggtcaactacagaagatcaaattacatctatgcgttgacatgctttgcctatacacgttagtatgtgataactgataagtaagactaaccgatacacatggtgacaacaccaaatctgcagtctctgccccggcgcttcatttcatttagaagagtagccacacaccgggcacctgaacatacaaagaatcacaagtttaaccgactttgctcagaaaaaaaaatatagcaggtaagtagatgttccattacctgttgcacccagagggtgtccaagggcaatcgcgcctccatttacatttact

SEQ ID NO: 775 - DNA, 370 bp, Zea mays
  misc_feature (38)..(38): n is a, c, g, or t
  misc_feature (40)..(53): n is a, c, g, or t
  misc_feature (55)..(57): n is a, c, g, or t
  misc_feature (59)..(62): n is a, c, g, or t
  misc_feature (64)..(64): n is a, c, g, or t
  misc_feature (67)..(68): n is a, c, g, or t
  misc_feature (73)..(76): n is a, c, g, or t
  misc_feature (80)..(85): n is a, c, g, or t
  misc_feature (89)..(95): n is a, c, g, or t
  misc_feature (97)..(99): n is a, c, g, or t
  misc_feature (101)..(113): n is a, c, g, or t
  misc_feature (117)..(119): n is a, c, g, or t
  misc_feature (357)..(365): n is a, c, g, or t
  unsure (1)..(370): unsure at all n locations
tgttgaccggattggctggatgggccgaaccaggtccngnnnnnnnnnnnnnngnnngnnnncnggnntggcnnnntggnnnnnnccannnnnnntnnngnnnnnnnnnnnnntggnnnggtgcgggccgcaagtgtgagtgagacgtcaccatcgaatcccaccacaaaagctcctttcgtcacaccggccagcacccagcttctcctctcctcacccccacgccccaccccaccaaacaatggcgccggcggcgacttccacagcctctgcgccctcctccttccactccaccggtaggcatagggccagggtcggggcccggccatcgctcgtctctctccgcgtcagagcagnnnnnnnnnaacgt

SEQ ID NO: 776 - DNA, 716 bp, Zea mays
  misc_feature (33)..(33): n is a, c, g, or t
  misc_feature (154)..(155): n is a, c, g, or t
  misc_feature (207)..(207): n is a, c, g, or t
  misc_feature (245)..(268): n is a, c, g, or t
  misc_feature (271)..(271): n is a, c, g, or t
  misc_feature (346)..(346): n is a, c, g, or t
  misc_feature (364)..(365): n is a, c, g, or t
  misc_feature (453)..(453): n is a, c, g, or t
  unsure (1)..(716): unsure at all n locations
ctgctggtggtcatatacagaaggtgatattgngctattaaaacacatccgtctaatgaaatggctccgtgtttgtgcaaaaatatatcatggcccaagataaatagatggcctcagtttacgtcttcaaccttggataaagacaaaggacatnngattgtcatgtagtagtagtacaatgtacaaacgagggcaggttacaccacntgtaaattttcttgtggacagctcttacatacactgtnnnnnnnnnnnnnnnnnnnnnnnnaanggaggatacagcttttacaccttcacatcaacctacctagcctctctctctctctcacctaaactcctactttcnctgtcattattctgtagnngtacgaggaaaaaagaatcatttctctgtaaacgaatggcaaaatggggccaagtgttggtgtgatgttttacatggcagacgggggngttttgggcatgagcatcagccaaatccatggaacccggcagattggtacgagttggacagctttggcagcttgagaactgcgagcacacctgctgccagggagaagaccgaagccaagacgaacgccggggtattccctcctccatacagagcgtcccatggacctgctccaagcgacactactatctgtaaattttcatatggcagcattagtctatggatatcttccacagcccgttcaaaacaaaacggtactagtagc

SEQ ID NO: 777 - DNA, 584 bp, Zea mays
  misc_feature (20)..(20): n is a, c, g, or t
  misc_feature (25)..(28): n is a, c, g, or t
  misc_feature (41)..(41): n is a, c, g, or t
  misc_feature (45)..(46): n is a, c, g, or t
  misc_feature (52)..(52): n is a, c, g, or t
  misc_feature (55)..(55): n is a, c, g, or t
  misc_feature (58)..(58): n is a, c, g, or t
  unsure (1)..(584): unsure at all n locations
tctgccatcatggtcaagangcaannnnttgctgttggcgncttnncttgtnttntcngcagcagcagcagcaagagttttaataagcagcagtacaatgctgcatgtcctagtgttgcttctgctattagtccagtgttgccgcgccatccgtcctcttcctcctctgcatggcaatggccatggacatcctgcggcatgcacccaagaacgctctcgttccgccagcagccagagcaaggggagactactgggcatggccgtcaccaccatgacagtcacagtgatgacaagtaccacggcgtcagggtggcgaagcagcagcagcaggaggagaaggctgcttatcacaagacctggaactcggtctcctccggcgacttcagcttcacgtccacagcgtcgtctgacgcggaggctgtcatcatccaggctctgcgctcggaccgcctcttgtacgagcctgcagatcatatggacgaccacgacgacgcctcctgctgcaggcttatcaagcagccgccgcacagcaagcagtccatcagcaggcagaagcaggccgccgtgggcgacgacgagccgca

SEQ ID NO: 778 - DNA, 803 bp, Zea mays
gagctcccaagtcgtgcagctgtatgtaaacctagctagctagcaacaagcgaagctagctgctgatgcagttgctgctgtctctcggagaggcactactactggagggggggtgatcgagatgagagggagcccatgagtggtcacataagtgagggctttataggggaatggggaaggagctatagcagcagcacactagaagcaataagggatgagtgggagcgagaggggatggatgaggaggaggtggaagaagaagaaggagaaggaggctgcttgacgagatgataaatgcataatgtcatgtgcaagaaagaggtgaggtgttgtatactagcttattagtagtccggcctccttcctactagtactagatatgcatggtagctagtgcagcaggtgtcatgtgtgtgtgaggctacaagaacaaaggttaagggcacaggcaaagggctggagagagagagagaacttgcaagcttgtcatggtgctgctctgctcagatcaggggccatatgcattgcatgcttagaaggtggggcaaagtttgccttaacatctagatctaggtaccacagcgcctatacatgatcctctctctctctctctctctctatgcatgccttgacggttactagctagctaattgacaatccctatatacaatatagagtagctagctcttgtgttgtcccctttctatctctgcatatagcttgtgcttgtccctggaaaaaaaactctctacatatcggatgtaaattcattctatggcatacccctacattttcgacctacg

SEQ ID NO: 779 - DNA, 617 bp, Zea mays
  misc_feature (31)..(31): n is a, c, g, or t
  misc_feature (539)..(540): n is a, c, g, or t
  misc_feature (564)..(565): n is a, c, g, or t
  misc_feature (569)..(573): n is a, c, g, or t
  misc_feature (588)..(589): n is a, c, g, or t
  misc_feature (591)..(592): n is a, c, g, or t
  misc_feature (601)..(607): n is a, c, g, or t
  misc_feature (613)..(614): n is a, c, g, or t
  unsure (1)..(617): unsure at all n locations
cacattcgatatgtcactagaaatctacagncaaaccccaaaattacacctttcacttttacagccacaagacaaggtcaggtcacgtatgcagctatgtacagtcaccaggtgatcggcaaaatcctcgtgtcctaagaggatttcatcttgtccaggttgtgcttagcctgcaaatcatataaagattgcatgagcaagagattcttatctttaatcgcagcttcaactaatctcagcaaacagagatgtggagttcgaagccctgaccgaaatcgcatcgatctcctgtaacaagggctggacggcataggccagcatcctggcatcttctgctagatcctccaagtcttgacagttacccatcagcagcgctacgaagaactctctttccgggatgagcttcagtgctacctgacaactatgctcgacagattaggtcagtgagcaaaaaccaaacctactagtaattagtagcacacttagctcagcaagcatgaccacaaatttaaacaacaaagaagtgtatctgcaaaccnnaaagtaatagatgtgactgtactnnctgnnnnntgcggaataagtatnnanntgatatacnnnnnnngcagcnnacg

SEQ ID NO: 780 - DNA, 460 bp, Zea mays
  misc_feature (67)..(70): n is a, c, g, or t
  misc_feature (96)..(96): n is a, c, g, or t
  misc_feature (112)..(112): n is a, c, g, or t
  misc_feature (115)..(115): n is a, c, g, or t
  misc_feature (269)..(269): n is a, c, g, or t
  misc_feature (272)..(272): n is a, c, g, or t
  misc_feature (427)..(427): n is a, c, g, or t
  misc_feature (429)..(429): n is a, c, g, or t
  misc_feature (435)..(435): n is a, c, g, or t
  misc_feature (437)..(438): n is a, c, g, or t
  misc_feature (456)..(456): n is a, c, g, or t
  unsure (1)..(460): unsure at all n locations
ttcctcgccgtcacctacgccggagccatcatcgcccctctcaactaccgctgggtgcgtgcgtgcnnnntcctccacttcatctccttttctcgnttcttacagcacacancantcactccggcaaagagtgcaagtaagtttcgtcgtcgtctccccctgttgtgaagcagagcttcgaggaggcggcgcaggcggtggagctcgtgcggccgacggcgttcgccttcgacggcgcgttcagctcctgggcgcttcggctgatgganggngacaggttcccatccatcggcctctacctcctcctgggcgatccttgcaggaccggccgcgctgctgcaggttctggtgaggttcttgcttgcgttgcatgcgtgggcattacaagagactctctgcacgcacctagcacttgcaatttacacangnttgctntnntcttggacacatgttggnttca

SEQ ID NO: 781 - DNA, 217 bp, Zea mays
  misc_feature (117)..(117): n is a, c, g, or t
  misc_feature (180)..(181): n is a, c, g, or t
  misc_feature (187)..(187): n is a, c, g, or t
  misc_feature (207)..(207): n is a, c, g, or t
  unsure (1)..(217): unsure at all n locations
atcttcttctgataaactttcatcactactaggtcatctggataactcttcatgtgttgatagtagggaaggacagaaaaaagctatggcggccccagtcgatggtgacaccgaagncgcaagagcaccaccatcttctgataaaacttcatcactagataatctggataatccttcatnngttggnaaggaagaacaggaagaagntgtggctcca

SEQ ID NO: 782 - DNA, 544 bp, Zea mays
caggcggcggcggccggcctcacggtgtgccgcacctgggccttcaacgacggcggctggagggcgcttcagaagtcgccgtctgtctacgaccaggatgtcttcaaggtagtaattaattataagataatatatatactatacatgcatggttgtggagcctgcgtggccacgatcgaagcctactacgattttcgcgcgaaaaatcgcagcatttatttgaaaccggccggccttaagtgagatgcaatgcaaggatacatgcttgcttagcttattaatggagatttgatttgtttatgcatggacgcacgtacacgacgaagctaggcgctggatttcgtggtgagcgaggcgaggaagtacaggatcaggcttatactgtcactgatcaacaactgggacagctacggcggcaaggcgcagtacgtcaaatgggccggggacgacgccgccgccgacggcggccgcctcaacatcaccgcctccgatgacgatgacttcttttccgaccaaaccgtgaaggtctacttcaagaaccacg

SEQ ID NO: 783 - DNA, 673 bp, Zea mays
  misc_feature (18)..(18): n is a, c, g, or t
  misc_feature (180)..(180): n is a, c, g, or t
  misc_feature (193)..(193): n is a, c, g, or t
  misc_feature (278)..(278): n is a, c, g, or t
  misc_feature (368)..(368): n is a, c, g, or t
  misc_feature (395)..(395): n is a, c, g, or t
  misc_feature (413)..(413): n is a, c, g, or t
  misc_feature (437)..(437): n is a, c, g, or t
  misc_feature (456)..(456): n is a, c, g, or t
  misc_feature (464)..(464): n is a, c, g, or t
  misc_feature (474)..(475): n is a, c, g, or t
  misc_feature (477)..(477): n is a, c, g, or t
  misc_feature (484)..(484): n is a, c, g, or t
  misc_feature (512)..(512): n is a, c, g, or t
  misc_feature (527)..(527): n is a, c, g, or t
  misc_feature (536)..(536): n is a, c, g, or t
  misc_feature (538)..(539): n is a, c, g, or t
  misc_feature (584)..(585): n is a, c, g, or t
  misc_feature (587)..(589): n is a, c, g, or t
  misc_feature (591)..(593): n is a, c, g, or t
  misc_feature (595)..(595): n is a, c, g, or t
  misc_feature (604)..(608): n is a, c, g, or t
  misc_feature (616)..(620): n is a, c, g, or t
  misc_feature (626)..(631): n is a, c, g, or t
  misc_feature (635)..(635): n is a, c, g, or t
  misc_feature (639)..(641): n is a, c, g, or t
  misc_feature (644)..(660): n is a, c, g, or t
  misc_feature (662)..(672): n is a, c, g, or t
  unsure (1)..(673): unsure at all n locations
tagggaggcagaaatatntctctctactgggtcttgaacatgtggcggatcaggtcgacgacgcggttgctgtagccccactcgttgtcgtaccaagagacgagcttgatgaagtggtcgttcagggcaatcccggccttggcgtcgaagatgctcgacctgggtgagtagaaacagccnagtgacaaaatgnatcagaatatgtccaaacaaattccacaaacgacacaatcagaactcaaacataagcgtgtgctataatggtcagttatgttggnttcctaataaatggtgccagagcagagagcccatacctgctgtcaccggtgaagtcggtggaaaccagatcctcctccacgtagcccatnatacccttgagtgggccctcagaagcngccctgtaaagcaatagnaattatgtcaatgctattactgtnaatcctaaccgaagcaganggagaaantactatgtannancaagacnatgcagaaaacagacaacattgagcatnaaatgtgatagtagnaataaatcnannaaggaatgttattgcattcatagacattggtttataaaaagaaannannntnnnantgactgagnnnnnaaaatgtnnnnncttacnnnnnngctntctnnnttnnnnnnnnnnnnnnnnncnnnnnnnnnnng

SEQ ID NO: 784 - DNA, 821 bp, Zea mays
  misc_feature (47)..(47): n is a, c, g, or t
  misc_feature (56)..(56): n is a, c, g, or t
  misc_feature (769)..(769): n is a, c, g, or t
  unsure (1)..(821): unsure at all n locations
gaagattgagagtaaagacagaaagcgacaggggattgtgagtgacngagtggccntggagacagagaatgtaactgtgagaatcctgcattccaacctgtgccactggttttcaatcgtgtcgcacagcacaagggtggggaaaactgagtagggactagagagtgataagatagaacactgagtttggagagtagtatgttaagaatgattcatggagagggctatagaggcaattttgcctaaccaaaaaatagaagggatgcctggtaaactggctagaccagatatgcaagtgtgcagatatttatatagaatatcaccattcaccaaactgcttgtaggtcactaacttcaagtgcagattatcaggagtatatcacacataccatggatgtggcaaggattctgagccttgtagcagcagctcttgcaacactggaatgggcacctgaaaggccaagcagagtgcgcgcatataattcattaacaaataaaaaatcaccgtggtctctatcacataacaaaggtgaaggttcttagttgcctgtaaactgcctccgcacaccataccacaagtaggaggaaatagttctgcctaataaggaagtatcgataaactctgtcttcttaccgggagcgggcgatgttaccacacaggatgcacttgggcttgttaaggccccggaggtttggcttgggcatgtcgaaggcggcggcaggaataggaggcggcttctgtggtgtcccattgctgttggccactgcnggcgcaggagcaggactagcagcagagggaggcgagtcaccagccaccacct

SEQ ID NO: 785 - DNA, 707 bp, Zea mays
ctctttcttcaggtgaccttggaagcaacacctctgtgatacagctaaaatgcaagcacacaaaggcgcttttctcatttgtcatttgttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtacggcctccaggtcaccagtgtctacgaggatgggtccgtgttcagccctgaggtgctcgacctttctgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcatacccacatgctgacaagatcaaggagtacctcaaggtaaaacgtgctttcttgggttatggaagttgttaagcaactcaaggccttgcataattctggtttaatttgattacagtccatatctatgaatgtgtcttgttggcatttaaactaccatgcatacctatgcttctttgtccatatcatatgtactgtatcatcagatcacgatgtagctagtttatgtcttggaaccatgtgtttttaactattctga

SEQ ID NO: 786 - DNA, 699 bp, Zea mays
  misc_feature (576)..(579): n is a, c, g, or t
  misc_feature (588)..(588): n is a, c, g, or t
  misc_feature (591)..(592): n is a, c, g, or t
  misc_feature (622)..(622): n is a, c, g, or t
  misc_feature (628)..(631): n is a, c, g, or t
  misc_feature (659)..(664): n is a, c, g, or t
  misc_feature (673)..(673): n is a, c, g, or t
  misc_feature (678)..(686): n is a, c, g, or t
  misc_feature (688)..(693): n is a, c, g, or t
  unsure (1)..(699): unsure at all n locations
caacaggagggaactggacgcaaggactggacctaaagtcactaaacaactgtacagaaagtccctttcgggaggggtgactttcatatatatataaccaagatataacttggcgtacaagtaagatacaaacatatctatagactatacatatctctagtagtgtcttgttcaccatattataaagttatgtaacactgatatatatctgaatgtgttagtgaagacaaaagtctagcacttaccaagcaggtgatctgcaagtgagccaagtgccatgtactcataaaccagaagcctttgatctccatctgcacaatagcccaccaaattgactaggtttggatggtgcaataggctgagcatcaggacctcaactaggaactctctgttgccttgatacccattcaggtctagttgcttgacagcaacaagctgttcacgcaaaccggaaacaagtcagccactaatgactgtagatgaattagcaagcttgtgtatacgtagaacgtttgaatgtttttttctgtgtggtgtgtacctgtccgttttcaagcctgcccttgtataccctgnnnnatccccctnctnngagaaggcagtcagagcggaagtttttcgnggccgnnnntagctcacggaacgtgaatgcttttgcnnnnnnggcaacagnacaannnnnnnnngnnnnnncgatgc

SEQ ID NO: 787 - DNA, 414 bp, Zea mays
  misc_feature (227)..(262): n is a, c, g, or t
  misc_feature (269)..(269): n is a, c, g, or t
  misc_feature (338)..(338): n is a, c, g, or t
  misc_feature (340)..(340): n is a, c, g, or t
  misc_feature (344)..(344): n is a, c, g, or t
  misc_feature (357)..(357): n is a, c, g, or t
  misc_feature (375)..(377): n is a, c, g, or t
  misc_feature (389)..(390): n is a, c, g, or t
  unsure (1)..(414): unsure at all n locations
gcggatgcagtcggtggagttggcccgcgacgccagccagatgccgccgccaaggatcgggatcgagatcaggaaggttatgaagttgacaacccccagcatgcccgtgcccccgcgcagcatcttgctcttgctcttcctggctgctgtgctgtctcctggaccttctcttctcctcttcctcgacctgctgctgttgctctgctccgcttccttggctctgcgcnnnnnnnnnnnnnnnnnnnnnnnnnnnnnnnnnnnnaactgtnctgccttctctctgctgtgccgttgcctgctctgcttctttgggcgtcgggtgaggagacagagagagngnacgnctggatacttgtnggcttttaacgaggtcgnnnaggagcacgctnncgcggctgttcggggagagcaacg

SEQ ID NO: 788 - DNA, 713 bp, Zea mays
  misc_feature (41)..(41): n is a, c, g, or t
  misc_feature (88)..(88): n is a, c, g, or t
  misc_feature (95)..(97): n is a, c, g, or t
  misc_feature (208)..(208): n is a, c, g, or t
  misc_feature (214)..(214): n is a, c, g, or t
  misc_feature (382)..(382): n is a, c, g, or t
  misc_feature (424)..(426): n is a, c, g, or t
  misc_feature (536)..(536): n is a, c, g, or t
  misc_feature (595)..(597): n is a, c, g, or t
  unsure (1)..(713): unsure at all n locations
tttcatttcatccttgcatgtgcctttcctttccatccacncacttgatggctgtagtctcgatagagttcgttcgttcgtacttcgnaccagannntgaactcccacgcacatgatttagtactagttttaccatgcattgttcagtaaaagtatatgcttgcttgatcagtggttgtttcaatcagaagattaaaaaaacggaatntaatantaaaaaaaaggggaagtggctagggaattcctcagtcctagctagctagctcaccggtgggaacgccatgcttggcttgggtgcaggtacatatatcttgggctattcgacagcgaagtagaggctgcaaggttgttcacctcggacgattctgccatttgttcatanacaccatgccttttgatttctctcttgcaatttctcttcttnnnttatcatggcttttgattcccaaagggttgagtaccgactcgatattcgattctccctgccgtttcgtgaccccagggcgtacgacaaggccgcgatcaaatgcaacggnagagaggccgtgacgaacttcgagcccagcacgtacgacggggagctgctgctgactgnnnaagctagcgctgaaggtaattaagtagctgctcgctgccatgtaatcttcagatgacgccgctgttaattattagctcatcagctttctgacgatcagcccttgtttttgtttctg

SEQ ID NO: 789 - DNA, 893 bp, Zea mays
  misc_feature (15)..(17): n is a, c, g, or t
  unsure (1)..(893): unsure at all n locations
tgcctgcagctaccnnnttaatttcaggtacagcagcagctggttctgctataatagctgcatctgtggtgctgctctctggcttttttttgtttttcttcttggatccaccaatgttctcaacaagctttgagccagatgacaaatgctcaccatgctcatccaggctaggaacttcgactcttccttttgcttttttggagctagagctgactctttcagtaccaacataatcaccattagaatcttggcctgcatggcctgatctactagcaaacctttcattctccgccaacctggatgagtcatttgcatcttcattaatttcatgcagatcagagttatgataaacatgcatgtccagatttcccgcccctttccgcttcctttcaccacttgctgctggaggtttcatgacatcactaatctgttctgtcaccatcacatccacatcacgtaaatagccagtctctgaacccttcccttcgaatcctttgctctgggagggttctaaatctgcatcagtagtaggatagttcattttggccactttagcaagcttgtttggctttttggcaccatgtgctggtctataatacccagaatggtgacgctctggcttccgttcaagataatgcacttccccgccatcttcaaacttttccgaggaatcagattctgtctcatcactttgagcatagacagcattgctcctggagtgcttctggccagtcctatctagttgtgtactggatttacctgccatcttcgcttgtgatatcttgcttctagggtcagaaccaacatgggcatcattaacctgctggtcaatacttttataggacttaaccttcaggccataaccagcttgatctttcctgctcctgtaatca

SEQ ID NO: 790 - DNA, 512 bp, Zea mays
  misc_feature (56)..(56): n is a, c, g, or t
  misc_feature (144)..(144): n is a, c, g, or t
  misc_feature (146)..(189): n is a, c, g, or t
  misc_feature (218)..(220): n is a, c, g, or t
  misc_feature (283)..(283): n is a, c, g, or t
  misc_feature (341)..(341): n is a, c, g, or t
  misc_feature (420)..(420): n is a, c, g, or t
  misc_feature (465)..(466): n is a, c, g, or t
  misc_feature (495)..(498): n is a, c, g, or t
  unsure (1)..(512): unsure at all n locations
ggacgacggttcgtgagcgactttcccatatacgatggccgtggctccggcgcccncctcgtcgctcgcttgcagggagtcactgtccaaatcggcagctcgcaccagctagtcagcatcgtcttcgaggccgagaggtagttnannnnnnnnnnnnnnnnnnnnnnnnnnnnnnnnnnnnnnnnnnnngcgattcattcattggttcatcgtcgtcnnnaggcttaagggctccacgctgctcaccaacggagtgataacggatgggtcagacgagtgggcnatctacggtggcaccggggtgttcgccatggccaccggtgtcatacgaagaaggtttntcgccggtagcaacgacggcaactctgatgagcttaccagcatcgaagttttctgcccggcgtttggctcggcacaacnacagccaaacaagcaggtacgtagtgtgtatatgtcagagaaaanntcaataactcttttaagaatgacagcagnnnnaattctcagtaaca

SEQ ID NO: 791 - DNA, 769 bp, Zea mays
  misc_feature (18)..(18): n is a, c, g, or t
  misc_feature (438)..(438): n is a, c, g, or t
  misc_feature (635)..(635): n is a, c, g, or t
  misc_feature (652)..(653): n is a, c, g, or t
  misc_feature (686)..(691): n is a, c, g, or t
  misc_feature (700)..(701): n is a, c, g, or t
  misc_feature (723)..(724): n is a, c, g, or t
  misc_feature (737)..(737): n is a, c, g, or t
  misc_feature (749)..(756): n is a, c, g, or t
  misc_feature (758)..(765): n is a, c, g, or t
  misc_feature (768)..(768): n is a, c, g, or t
  unsure (1)..(769): unsure at all n locations
ttaacccgcgcggaccantctaacacaggcattccatgtcctgagattgcagttcagttcaatttttgtactggcagaagatgggaatactcttgcaaaggattagaaagaggctataacataccgtgaagatgataatgcagcgtgttattagaaacaaagtcgtatacaagtaacctttggtcattggaaatgcagtatcccacaagagaaaccaaatggcggtggtgcacgcgactaattatctccacttcggcctggaactcgcgctccccttgtccgccgccatcctttagtcgtttaacggcgacatctttataatctggcaggcggcccttgtacaccgacccaaagcctccttcccctagcagcctctgagctgagaaaccatcagtgatctgatacagctcatcatatgagaagaacctggagttgccnatgctgatatcagacaagcattgtttcagcctggggctcccggcgctatagttggtgtggacagaaggatcagctgaccatcctacatttgcagattcacctgaaggaagcgggatatggtatcagtggccgtgttgctagctattccaaagagctgcatgctgtattaagctagatgcagaaacaaagtatttcangtccctggaattttcanncaacaaccttacacaatcagccagcacagtgannnnnncaactcacnngataatttattaaaaaatgacnnaaaagctgtatgntgcatgatatannnnnnnnannnnnnnncana

SEQ ID NO: 792 - DNA, 659 bp, Zea mays
  misc_feature (5)..(5): n is a, c, g, or t
  misc_feature (342)..(342): n is a, c, g, or t
  misc_feature (392)..(392): n is a, c, g, or t
  misc_feature (542)..(543): n is a, c, g, or t
  misc_feature (583)..(586): n is a, c, g, or t
  misc_feature (591)..(594): n is a, c, g, or t
  misc_feature (619)..(619): n is a, c, g, or t
  misc_feature (630)..(631): n is a, c, g, or t
  misc_feature (633)..(640): n is a, c, g, or t
  misc_feature (644)..(647): n is a, c, g, or t
  misc_feature (649)..(649): n is a, c, g, or t
  misc_feature (651)..(653): n is a, c, g, or t
  misc_feature (655)..(657): n is a, c, g, or t
  unsure (1)..(659): unsure at all n locations
tgccnaatgagaaaatgctacgtcaatcggctgaagatgaggccagtgacctcaagaatcaaatatcacactggaaaaagctggaggtgttgttagcttaaaacctttttttgtctcaaagtattgcctcagtgtcctgatagcaaaggggcttccctcgctcatcttgtaggctacagctacagctgagataataaaactacagaaaatgctagatgctgaagctagccagaaagagaaacttgaagaagaaataggtgttttgagaagccagttattgcagatgagtatggaagccgatgaggtaattgttactatcattgtcaaggattttttccccanggaagctgctatatctttttgtaacttatttctatttctgacttgaacangctgccctaacatagtcggtatgttttctcttcattcctatttggtcacatcagacaagaagtcttgataaaggagatgggccaggaaaaatatttcctggtttagattcattggtgtctcagactcgaggttcacaacccagagagcannacaatggacagaagcaaccgattgccaaactctttgaacnnnntattnnnnatttattcttttacagtttctgctngatctgcctanntnnnnnnnntctnnnngnannntnnnaa

SEQ ID NO: 793 - DNA, 654 bp, Zea mays
  misc_feature (477)..(477): n is a, c, g, or t
  misc_feature (537)..(538): n is a, c, g, or t
  misc_feature (542)..(545): n is a, c, g, or t
  misc_feature (547)..(547): n is a, c, g, or t
  misc_feature (572)..(576): n is a, c, g, or t
  misc_feature (585)..(585): n is a, c, g, or t
  misc_feature (592)..(597): n is a, c, g, or t
  misc_feature (605)..(605): n is a, c, g, or t
  misc_feature (607)..(611): n is a, c, g, or t
  misc_feature (613)..(613): n is a, c, g, or t
  misc_feature (616)..(627): n is a, c, g, or t
  misc_feature (631)..(633): n is a, c, g, or t
  misc_feature (636)..(637): n is a, c, g, or t
  misc_feature (641)..(653): n is a, c, g, or t
  unsure (1)..(654): unsure at all n locations
gtgctcaacatttggtgcttgggacctgaacaccatgtcaccgtgtttccacagttcccacacagttcccagcaaaagagtggtggagagggtttccatgggtactcctagcggagctgtggaggtccacagttcttgcaccgcggcgatcatgtttgggttcactccgattctcatccagaaggctcgagcgaatggacacataaagataatgttgtttgtgtcctcaccggcgagcccacaaatgccacaagtgttcatgtcaaggacattcttctttctcaggtttatattgcagtgactgtgattctaaatcagaagccaagtaaagaatttttcactccggacagaggccttgtagatgagatagttggctagtcgcatcgtcttcatcttcaaagaagcatgagggcacgtctgggttgtcactctggttcacacctaacagcatggactccagttcgattgtcacctgcnggctcaagtgtggtttcaattgtgttgcaagtctggaagacataacttcaattgaaactnntctnnnnangtggctgtgtagggatggcagttgnnnnnacaacagcncgtcacnnnnnnactgatcntnnnnnantgnnnnnnnnnnnncatnnnacnnctgnnnnnnnnnnnnnt

SEQ ID NO: 794 - DNA, 654 bp, Zea mays
  misc_feature (102)..(102): n is a, c, g, or t
  misc_feature (105)..(105): n is a, c, g, or t
  misc_feature (518)..(519): n is a, c, g, or t
  misc_feature (522)..(523): n is a, c, g, or t
  misc_feature (567)..(568): n is a, c, g, or t
  misc_feature (606)..(608): n is a, c, g, or t
  misc_feature (630)..(630): n is a, c, g, or t
  misc_feature (639)..(639): n is a, c, g, or t
  misc_feature (647)..(647): n is a, c, g, or t
  misc_feature (649)..(651): n is a, c, g, or t
  unsure (1)..(654): unsure at all n locations
attatgcacttctccagtatcattggatgtagactcagcctctttattctacaatgtggaaggagagagaaatcacatttagaatttacataaaaaaagtgnccncaaattaaatactctctccattacaaattataagatgacttgacttttctagatacattgcttttattatatatttagacaaagtgtatatataagtgcatagtgcataccaaaagttacatgcctagaaaagacaaaattgtcttataatttggaatgggaacaatagcatatggcagacccagtgctagaggctcctacagggggtctagaaaagagagaaaccgaggcaagccttgtcccgaaaatgtggagagactgctttgaactcgagacctggtgactcgatgattcagtgaaaccgttctcaccactgcaccaggcctgcccttcactaatagcatgaaatttactaatttgtaaagctcaaataggtgtgtacttgtttcttgggtgattgctgatgtactttnnacnnctcctccagtattcttattgagtctaagtattcttcatgatacnncattttctcattctgcataaaaaggaaaattgattgannnatgtagcatacatcaaacacgntagagaggntctcttcncnnnatg

SEQ ID NO: 795 - DNA, 1069 bp, Zea mays
  misc_feature (487)..(487): n is a, c, g, or t
  unsure (1)..(1069): unsure at all n locations
aaatcccctctaatcttcctcactccaccttacctgaaactcatgcttggccagcttgggaagacgctctcatgtctgaggtgctagtttgctacagtgacacaactatggcttcaagcacatacataccatacaatactggggtcatgatgaaatgtggttgtttctatctctgaaacaaccttgaaatgaaagttgttcctgctctttgttatatgtggtgctgtctttgtatactgaaacttgggtcaaccataatgtagttcatgttctaatacccaagaggccaagatgctaccaccctttttgggctccatttcatactgtaattagttcaagatacaagtcaaaggaagtaaactgtaatccctgatccctttgcttgttggtattaatatacattaaacttgtgataacaaggaaagaatggtgatacatttaggccagcacttaattcttgctgccctgctggactgtacgtatttgnatcaaggaccatttcaagcctaactctattagtacacaaaaataagttacccaaaaaaaaaggagattgggtgctcaagtgttggggtcggagacaattctctcgatctcttccagcaaccgctccttctcttcggccaagtcctcgttcttctgttgaagctcctcgatctgcttggtctgctctgaatctttcctgcaaccaaccgtgtgtataaacattttaacaaacaggtttacaaagggaggtttgtgatcgctccacaaggattttccttagaaactcgtgtccttgcttgcagcagtgtacccacctgttcatgaaggacagattaagctttagcgaccgaacctccttctctagggtttcgcagcgcttaagaacggcctgcatgtcggacggtattactggtgtagagcttctttccttcgcttctgccattctgaaccataagaacgtaatggaacatcacatactgtatggtaattatcaattaatgtggaccatttttttaagaaggggggagcatcacatacttgcgggagcgctcaaccctgcgctttttcataggatctccattat

SEQ ID NO: 796 - DNA, 589 bp, Zea mays
  misc_feature (559)..(561): n is a, c, g, or t
  misc_feature (563)..(566): n is a, c, g, or t
  unsure (1)..(589): unsure at all n locations
gcaactgaactgggaaagaaggccagggagttaaaaaaagctgctgaagccctacaccaagaagaaagaagtgggaacaagggccggaaatggcgcaaaaatgtgaaggctttagaaaaggtacatattgtattgaaattgctctttccacacattggtaatgtttgtatgttacttttacaaaaatgacaactatatttatccttttacatgtggtgtcataaaataatcccaagagattagttaatgtcatttgtcctttacagttgtaggcatgctacttcaaatacgtaaaagttatgtacctatttgtttggtgcaatggtaacaacctgggtccctgagggtgtcactactggggaatgctgcgctttgcaatactttagtcatgtctgtcgatgatcagaataaagaagttatcacttccaaaactttggcttaaagaaaacttggaagtatttttaacatgtatttatagaagtcattgcattttggagttttagtggttaacaagttctctagttgagttagtgtgaatgtgcatgccatattatgcttnnntnnnnttcatatggaatcatggtcctta

SEQ ID NO: 797 - DNA, 519 bp, Zea mays
  misc_feature (476)..(476): n is a, c, g, or t
  unsure (1)..(519): unsure at all n locations
tgcaacactttgctggtatgactcaagtgtttgccattgttgagtgttggtgtcaaagtaccatcctgggtattctgcgtagaacagcatgttcggtgggtattctgggggtcctgcgttggtcccaccctggacccagctcatggcattggtgctgctctcttccgcaatggtttcaagtgctgcatgtaaattgttttgcaagtacgatgcactaaactgctgctgatgttgctgtgtattgtcactcccaacggctacaacagcaccagtattatcagcaacgtaactctgtgcactgtgggtatctacctgataccactgctgtgtcgcctcatcatacttccaccccgggtagaggctctccaggtatttgggatcagtggagcccaactgtgcattagtgctttgatccccgtaccctgcactacttccactgggaccgaaatgagagttagcatttttatcaactccgncagagaagctgtgtccagcactaatcatggcagtgttatacac

SEQ ID NO: 798 - DNA, 806 bp, Zea mays
  misc_feature (112)..(112): n is a, c, g, or t
  misc_feature (392)..(396): n is a, c, g, or t
  misc_feature (434)..(444): n is a, c, g, or t
  unsure (1)..(806): unsure at all n locations
gacgtgacgtcctctctctcttctggcggtccgggcatttcgtggtcggccgttggggctcagggcgtcgccgtgggctttgaccatggcacggcatgaggcgacacctgcnggccatgccgacgactcgccagagcagagcaccaacgcccgcagccgcaggcagcaggcggcagcctttttggtgcggccacctccgcctgacggacccagctgccttgcctatacgatgccaccagccaccccgacctgtctcgtcctcccgttttatttcacctcagctcaacaaaaaagctgctgcctgccaacttgggagcccattcctccgccctttccagttcaggtgcaggttcgttccggctgcgcacgagacacgagccagagccacgctnnnnnctcacgtgcagtgtctgtcacctcgcaagtcgcaacannnnnnnnnnnaccacagaggtatccgattcgccatctggaaatgcacacgaaacactcgcatcatctactaaaacgcaaagacagactgacggcgggcgggtttcattctcggtcttgaggggtacaacaaatacaaagcacgctactagtacaaaccataggaacaggaaggagccggctcttacacagagacttctgttctgttctgttcttaatgaggtcggtacaatacactacggcaaaacaaataggtaggacgagggcgtaggcggcggcggcgtgacgatcgatctccactccaggcgacagcgcactagtgagcgtgagcgtccaccgtctagtggccgcccgatcgacggttcctcgtcagt

SEQ ID NO: 799 - DNA, 864 bp, Zea mays
  misc_feature (147)..(147): n is a, c, g, or t
  misc_feature (405)..(405): n is a, c, g, or t
  unsure (1)..(864): unsure at all n locations
taaccgtctctcctgtgtcctcatccagcacgaccagattcagtacacatgatgcctgcctgacgtgagcatctggcaggttgtggacaggatcagagacgccctcagcttcagattagtgtgtgcacctactgagaataaccacantatgtgttgcccgtcctgattgttgttttcacctatcctgataatagtaagagtttgcaaaaatgcaaaggaaatggtggagtagccatcacttgtgcccatgtaatacttcaagatcagcgtagagcgtagtcaagagttaaccagagaccaagactgggctaatcacacacgcattgggaaaccatgaaagggcacattgcacgctaaagtaatatagccacgagatctaggctaggcgcaggcgtcgcaagttgnagcagcagccttgcaggcactcaattccacaacttgagccagtatcagacacgctgctttctcgtttgagccagcagcccagcaggtgcaaacttttgctggtggtagacaaaattggttacaaaaatcaacagtggcagtcctctgatttgggatggtgacactgggaaacaaagggcctgctaggtacaacttaatagtttataatgtgcttatgactagagaatgcttggtcacgcttctcaccacttgccccattagtactaaaacacataaggtaggtcaaacctgctttttctaaccacatttttcctccatttgtgcaactttccagggaagagtttattagagaagctgcaccctttgggcctgttcatttgggattataatctgtccaggttatataatctaacttattttgaactaacacgcagttcaaaatatattcagttgggattt

SEQ ID NO: 800 - DNA, 566 bp, Zea mays
  misc_feature (81)..(81): n is a, c, g, or t
  misc_feature (127)..(127): n is a, c, g, or t
  misc_feature (165)..(165): n is a, c, g, or t
  misc_feature (168)..(168): n is a, c, g, or t
  misc_feature (200)..(200): n is a, c, g, or t
  misc_feature (336)..(343): n is a, c, g, or t
  misc_feature (495)..(511): n is a, c, g, or t
  unsure (1)..(566): unsure at all n locations
aataggaactgaattagtggcattgttagcatgtacatgaaaacgtgatttgtgcagtgctgggattagcttgggaatgtngtccaaggatggccttatattgtttcctcgcaatttgtggttgganttttctatcccatctttaaagtacatttggaatgtttntanttcttcttggaagatgtttgagaagtgtaagntacagctatgtacgactatgattcctttcattgttttcatcaagttggtgtgaaattacccacctttgccatcgactacacaccttaccttggaaaacaaattattttttactgggtctcctgtccatcttgcacnnnnnnnngtaccatctcactggcggcaatcatgcctgaccgtccatctcatcggtgctctggctatggcgacgagacgcgcgtccgcctacgctctgtactacgacgagctctgagcctgcgccggtgccctggccatggcggcgagccgcatgcccgnnnnnnnnnnnnnnnnnacctggtcgtgccggcccgcctgtgccccgccggtgtgctggctgccacatgtgc

SEQ ID NO: 801 - DNA, 466 bp, Zea mays
atatcagcagagtaataaacattatttaaacagaaacaatgtgaacaatgacaaaaactgattgctgtttggatagcattgtgatctttagtatggagtgcaccttctgtttgcccccattaatcttctaatattttctctgttcatatgcagagagcctgaacagctattctaaaaccatggcgaagtttcagaatatgcatgattcaagacagctcatggctgctgctaaccttgccaataaccagagcaacaccaaactaatggggaccaaacaagaagcaagtgcttctgcgaccaaccagactcctggtgtcggagccatcggcaataatgctcttcagcatgccacacctctaaacagctaccagaatatgctcagaagctccagtgcaaatccagtcttgctgcagcaggaggcatcgagtgtcttcaaaggtcctacagcaatgcacagtggcataca

SEQ ID NO: 802 - DNA, 477 bp, Zea mays
  misc_feature (50)..(50): n is a, c, g, or t
  unsure (1)..(477): unsure at all n locations
attgattctggctgccaactgtaagcaatcaaacagaggggcaagtcaancctgtaagtgaaaaacaacatggtaagatgagacagacaagagatgatttagttgagttaccctgctgctgtggagaagcggtagccgtagtgatgggttcaggatcctgcaagccaagcagaagagagcagacagagaggcggcgtaacgtaagataagaaggcacgggcatgggtggatgaagacggtgatggaaggaggatgcttcttcgtcttacagggactcttcgtagggcctcgtcgatctcctgtgtggtgaggcccttcttctcgaggaaggatcgtctgtagacgacgggggagcccctgacctttgggtgggagaggaacttgacggcgttctcgacgtagtcctccctcacgggctgcggctgcagcggcgtctcgaagacgagcttgttgtcgccggctcccgggtcagcatca

SEQ ID NO: 803 - DNA, 1355 bp, Zea mays
  misc_feature (1340)..(1351): n is a, c, g, or t
  unsure (1)..(1355): unsure at all n locations
ttggatctcctggagctggaacaagcaccatatttaagcaggctaagttgttatacggcaatagatttactgatgaggaacttgagaatatcaaactaatgatccaaagcaacatgtttaagtacctggggattctgcttgagggccgggagcgctttgaggaagaggctttggctgtaccaaatcacccaagctcagtgggcgatgatcctcagcaagatgaaagtaaatcttcaagttccaattcttgcatctactcgataaatgcaaaactgaagaagttttccgattggctcctggacatcatagcgacaggagacctagatacattcttccctgcagctacccgtgaatatgctccagttgttgatgagttgtggaaagatcctgccattcaagcaacatacaaaagaaaggatgaattgcattttctccctgatgctgctgagtacttcttgagcagggctgttgaagtatcaagtaacgaatacgaaccgtcagagaaagacgtgatatacgctgagggagtaacacaagggaacggattggccttcattgacttcaccttggatgaccggagccctatgtcagaatcctttggcgacaaccacgatgcgtaccctcaacaaccagtaaacaagtaccagctgattagagtgagcgccaagggcatgaacgagggctgcaagtgggtggaaatgtttgaggatgttagcatggtgatcttctctgtagcgctcagcgactacgaccagctcggagccccagcgagcggcagtagcaggacactcgtgaataagatgatccaaagcagggacctgtttgaggctacaatcaggcagccgtgcttccgtgacacgccgttcctgcttttgctgaacaagtacgacgcgttcgaggagaagatcgggcggtccccgctgtcgtcgtgcgagtggttcggcgacttctgcccgctggggacgcaccacaacagcagtcgcttggcgcagcaggcgttctactacgtggccatcaagttcaaggacctgtacgcggcgagcacggggcggaagctgttcgtgtggcagacgcgcgcccgcgaccggcccaccgttgacgaggccttccgctacgtccgggaggtcctccggtgggaggacgagcgtggcgtcgccgggtactgccccgacgagtccttctacagcaccacggagctcagctcgtcccgcctcatcgccgctgcacagtgactgtcgcagcgttgttttgtgtataatgatcgtatgcttgcttgtttcccgaacaaatcaaatgctatcaaatatagtgatctgagtgatgagcagaaaaaaaaaaannnnnnnnnnnnaccc

SEQ ID NO: 804 - DNA, 1159 bp, Zea mays
ttggtctgaaggactgcagctagcagcatctatgggttttcagttccctcagtgtgaaagtgtacatctttcggaagtggttcctttagcaagcaaagatgcaatcaatcttatctcgtggctttgctcatgggacccacgaagaaggccaacagcagtggaggttttgcagcatcccttctttcagccatgcttctatgtcccaccttcacttcgcttcaaatctactggatatgcatcaacgccaccatcagctggggctaaaggagctgttgatcagaagaacattaggagatactacatgggtactgtacccaatgcgaggccaacagttaattactcgtacttgagaaacaatgctcctgcaagagcagttggtgcacaaaggaaattggagttggattatcagctcccagagactaataaccataataaggtgacaaaggcagaagcgatgaaccagtcttggtccagaccagcagcagtaaggagcaatgcaggaaatcatcttgccaacgaccctgaacccagtgtacttgaccttgccgagaagctgtctcagttgtcaatgggccccaacagggtgtcgggtttgggttccgagaggtttgttagaacccatgagaacgctgccaagcgccccttgcccgtgggatccagggcgtggcatggtccagctgaccccttccggcgcccatacgagatgccaggtgatagaactctccttccaaggaatctcgttcgctgaggctgtgaagctcttcgcaagaaacatatccaacgctcgctgtcttcggagctactcttccccggctatttacctcgcaacaataaataaacaaccaaacttcgtttccagcagtgggtgttgctcagcattgtctgttaccgtgcttgtgcgtgacgaggataagaggcgtccgggtttgtgcaccccccccccccccgggggtcctcgagggctccagggctggttggttgcagcatggcccgatgtgtctccatgtgagatcgtttttttaattatgctgtgcgatgtgtgattggtaacactgcttcagttgttaccgctgcttgttcagtgggtttgtatgaactgtgacatgctccgctaaacgttattctaaatactggtatgcaaacatgtcgaaggtgaacg

SEQ ID NO: 805 - DNA, 735 bp, Zea mays
  misc_feature (65)..(65): n is a, c, g, or t
  misc_feature (170)..(172): n is a, c, g, or t
  misc_feature (264)..(264): n is a, c, g, or t
  misc_feature (347)..(347): n is a, c, g, or t
  misc_feature (435)..(443): n is a, c, g, or t
  misc_feature (447)..(495): n is a, c, g, or t
  misc_feature (499)..(509): n is a, c, g, or t
  misc_feature (514)..(522): n is a, c, g, or t
  misc_feature (526)..(526): n is a, c, g, or t
  misc_feature (616)..(616): n is a, c, g, or t
  misc_feature (622)..(622): n is a, c, g, or t
  misc_feature (666)..(666): n is a, c, g, or t
  misc_feature (668)..(668): n is a, c, g, or t
  misc_feature (670)..(672): n is a, c, g, or t
  misc_feature (680)..(680): n is a, c, g, or t
  misc_feature (682)..(682): n is a, c, g, or t
  misc_feature (684)..(684): n is a, c, g, or t
  misc_feature (686)..(729): n is a, c, g, or t
  unsure (1)..(735): unsure at all n locations
atccacctttgccaatgtacgtgacacacgggccactgtcagggacctgagcagccaccttgagnacaatgtcttcgacgtacttgtaagcctcgaacgagcctccgggcatcaaggacgggccgttgcgggcaccctcctctcctccagagacacccatgccaagatannngaggccgcgctcctccatggccttctccctcctctccgtgttctcgtaccactcgttccccccatcgatgatgcagtcgccctgctccaagngagctgcgagcgtcgcgatggtctggtcaactggcgcgccggccttgacgagcatgatcaccacccgtggcttctgaatgganttcacaaaggacgcggggtcatggaagccgtagacgggaaggtttccttctgccttggcacgctgcacggtctcgtccaccttggagnnnnnnnnnttgnnnnnnnnnnnnnnnnnnnnnnnnnnnnnnnnnnnnnnnnnnnnnnnnngctnnnnnnnnnnntatgnnnnnnnnngagnaagagggagtgcctggcgaccaatctccttcactagttggctagctttcttcagtgagaagtggacagtatctagctcattaccaattcncttcanttgctctgtctacaaaaaagcagcattttgaagttagaaactantncnnntcttctcntntntnnnnnnnnnnnnnnnnnnnnnnnnnnnnnnnnnnnnnnnnnnnncttggg

SEQ ID NO: 806 - DNA, 617 bp, Zea mays
  misc_feature (251)..(251): n is a, c, g, or t
  misc_feature (259)..(303): n is a, c, g, or t
  misc_feature (429)..(429): n is a, c, g, or t
  misc_feature (511)..(511): n is a, c, g, or t
  unsure (1)..(617): unsure at all n locations
tggatcgatcgagcgtagcgatctctcatcgtcggctacacgcagtagtataagttgcactcttccctcgtttcgaagcataggcagagagcatttaattttaacagcctatgtaggcacagttcgcgagtcgtgacaaaacgccaagttcacggcggaaccgctgccgccattgactgacgccgtggcattgccattgctgctgctcgcctcgtcggtgtcgagtggctcaaggtgcctgctacaatatnacccgttnnnnnnnnnnnnnnnnnnnnnnnnnnnnnnnnnnnnnnnnnnnnngcactattacgatgacaaacagagcctatgtataagatctaaatatatgcatcatgtgacataaaattaaatcttgcttagcttagcaaaaacatgtctaaatagattatcagccgcagtaggaangacatggttaaaggaagatggttctacatttctttcgtgatgacgattatataagacaagacaacgtcaaagttcagcacanttttattcttgctgacgacataaaaaacgagtgtgacgaggagaaaggcgagtcgtggtgatgaagttgacaaagacgacaagtcaagtaagcaatcgagccttca

SEQ ID NO: 807 - DNA, 680 bp, Zea mays
  misc_feature (11)..(11): n is a, c, g, or t
  misc_feature (39)..(39): n is a, c, g, or t
  misc_feature (64)..(64): n is a, c, g, or t
  misc_feature (70)..(73): n is a, c, g, or t
  misc_feature (82)..(82): n is a, c, g, or t
  misc_feature (103)..(103): n is a, c, g, or t
  misc_feature (105)..(105): n is a, c, g, or t
  misc_feature (149)..(149): n is a, c, g, or t
  misc_feature (167)..(168): n is a, c, g, or t
  misc_feature (199)..(206): n is a, c, g, or t
  misc_feature (234)..(234): n is a, c, g, or t
  misc_feature (236)..(237): n is a, c, g, or t
  misc_feature (296)..(296): n is a, c, g, or t
  misc_feature (474)..(474): n is a, c, g, or t
  misc_feature (488)..(515): n is a, c, g, or t
  misc_feature (520)..(520): n is a, c, g, or t
  misc_feature (588)..(591): n is a, c, g, or t
  misc_feature (599)..(604): n is a, c, g, or t
  misc_feature (607)..(608): n is a, c, g, or t
  misc_feature (625)..(625): n is a, c, g, or t
  misc_feature (627)..(627): n is a, c, g, or t
  misc_feature (629)..(630): n is a, c, g, or t
  misc_feature (632)..(632): n is a, c, g, or t
  misc_feature (634)..(637): n is a, c, g, or t
  misc_feature (639)..(641): n is a, c, g, or t
  misc_feature (643)..(647): n is a, c, g, or t
  misc_feature (649)..(660): n is a, c, g, or t
  misc_feature (663)..(663): n is a, c, g, or t
  misc_feature (665)..(665): n is a, c, g, or t
  misc_feature (667)..(669): n is a, c, g, or t
  misc_feature (675)..(679): n is a, c, g, or t
  unsure (1)..(680): unsure at all n locations
ataaaacaganattggtttcattttcagaggaactgganaatgttggcacaaagaaaccagtcngttatnnnncagtaaaangagcatcaactgaacttatananttcgaagtcatgaaccaatctatactccaactagagcttaacangctaccgcaaaattagcnnccccgggttcaccacttactcgcaaccgcannnnnnnnatatctgagcaacaaaaccaaaatcacncnnacacccagcttgcaattgtaaaatcccaatctgcattgctgtcttgttcctcattagtntccaacatatcactgtccaactgagccaccaatcaattggatggtgatgtaacccatctcgcctaccgctggaaccgtgggacatcagacatgagtcaaatttagtaactagcggtcaattactcggtttagggattagataggaaacaaccaaacagagaggaagaggaacgactantatcccataaactnnnnnnnnnnnnnnnnnnnnnnnnnnnntgaantgaggttgctcagactccaatttaggggtggacgtgtaaccaactgtgtataccttgacgatgacctnnnnctcgtacnnnnnngcnncgccccagatgatgagncngnngncnnnnannngnnnnncnnnnnnnnnnnngcngngnnngatctnnnnnc

SEQ ID NO: 808 - DNA, 573 bp, Zea mays
  misc_feature (306)..(306): n is a, c, g, or t
  misc_feature (347)..(347): n is a, c, g, or t
  misc_feature (509)..(509): n is a, c, g, or t
  misc_feature (563)..(563): n is a, c, g, or t
  unsure (1)..(573): unsure at all n locations
cgcaatagaaacagcgaagttcttcgatctcagtattaggccgccagcatatctgtgacttttactcagcaaaggtggcctcagcgaagatcgcaaactggacagccaatgttcctgttaagcaaactgttaccttaccacattagcaggcaaaatggtagtattgaaggcatcgctgctcgtctgaagaaattacctctcggatattttggtccgttgaaaaatctttacacctcgctccttttggtacaacagcaaccgaaaacgagtcactgatgttcgacaggtacatcaactttgacaacncaaaaggggtctcgatatgatcgttttcctgagacacgtanctatgttcggtgctgagctcggcaaacagggaatccttcttcctgacaggagcctcaaacacaaaccgtgaactgatacaagattctgcttctgagatgtctcttgggagcgagccagcgacattgacaacgcccttgacccgagtgctttcttctgcgaanggaccaactttggtagctttgaacaacgagatcactctttcaactttctcttgnctctccctca

SEQ ID NO: 809 - DNA, 644 bp, Zea mays
  misc_feature (541)..(542): n is a, c, g, or t
  misc_feature (559)..(563): n is a, c, g, or t
  misc_feature (566)..(566): n is a, c, g, or t
  misc_feature (568)..(582): n is a, c, g, or t
  misc_feature (590)..(590): n is a, c, g, or t
  misc_feature (594)..(595): n is a, c, g, or t
  misc_feature (598)..(611): n is a, c, g, or t
  misc_feature (615)..(619): n is a, c, g, or t
  misc_feature (621)..(623): n is a, c, g, or t
  misc_feature (625)..(631): n is a, c, g, or t
  misc_feature (633)..(634): n is a, c, g, or t
  misc_feature (638)..(643): n is a, c, g, or t
  unsure (1)..(644): unsure at all n locations
taaacctccccctgttacacctcaagttgtggatcttcttgatggtttgtcctcaagcacatctcttcctggtgagctcctgatgcttgattatccaatataaggaaaagttgcaaatacccctaaaagtcactgagtttgatttctcttccatatcaaactcaaggtgactccaaaggagcttttgcattagtaaccttcccataatcaatgaatttacttttactcaatttgcctgttcgccagatgagaatgcagcttacccgacaatcacagcattccagagtgcaaccttgaggatcacattcagtttcaaaaagcaacctggaaaacctcaggagactacaattaatgcttctttcacaaatttagcaactactgcattaacagatttcgtcttccaggcagccgtgccaaaggtagcaatcgcctctgacaccaatctcattcccaacagcagagatcttaaatagtcagccgtactgaccaatttgcttagtttctgctgtaaatcttataatcactcaagtgattgttatannatggaaacccttatatnnnnnaantnnnnnnnnnnnnnnntgtttatnactnncannnnnnnnnnnnnnttcnnnnnannngnnnnnnngnnaacnnnnnnt

SEQ ID NO: 810 - DNA, 1266 bp, Zea mays
  misc_feature (1)..(9): n is a, c, g, or t
  misc_feature (19)..(24): n is a, c, g, or t
  misc_feature (120)..(122): n is a, c, g, or t
  misc_feature (146)..(146): n is a, c, g, or t
  misc_feature (222)..(222): n is a, c, g, or t
  misc_feature (241)..(241): n is a, c, g, or t
  misc_feature (244)..(244): n is a, c, g, or t
  misc_feature (281)..(281): n is a, c, g, or t
  misc_feature (304)..(304): n is a, c, g, or t
  misc_feature (334)..(334): n is a, c, g, or t
  misc_feature (447)..(455): n is a, c, g, or t
  misc_feature (519)..(521): n is a, c, g, or t
  misc_feature (525)..(525): n is a, c, g, or t
  misc_feature (540)..(540): n is a, c, g, or t
  misc_feature (561)..(561): n is a, c, g, or t
  misc_feature (608)..(608): n is a, c, g, or t
  misc_feature (705)..(705): n is a, c, g, or t
  misc_feature (707)..(707): n is a, c, g, or t
  misc_feature (738)..(738): n is a, c, g, or t
  misc_feature (751)..(752): n is a, c, g, or t
  misc_feature (965)..(966): n is a, c, g, or t
  misc_feature (969)..(969): n is a, c, g, or t
  misc_feature (971)..(974): n is a, c, g, or t
  misc_feature (976)..(977): n is a, c, g, or t
  misc_feature (1077)..(1077): n is a, c, g, or t
  misc_feature (1113)..(1113): n is a, c, g, or t
  misc_feature (1146)..(1152): n is a, c, g, or t
  misc_feature (1172)..(1172): n is a, c, g, or t
  misc_feature (1174)..(1174): n is a, c, g, or t
  misc_feature (1179)..(1179): n is a, c, g, or t
  misc_feature (1195)..(1197): n is a, c, g, or t
  misc_feature (1214)..(1215): n is a, c, g, or t
  misc_feature (1225)..(1231): n is a, c, g, or t
  misc_feature (1244)..(1244): n is a, c, g, or t
  misc_feature (1246)..(1246): n is a, c, g, or t
  misc_feature (1254)..(1256): n is a, c, g, or t
  misc_feature (1260)..(1263): n is a, c, g, or t
  unsure (1)..(1266): unsure at all n locations
nnnnnnnnngagggctctnnnnnngtaagagcccccccgagctgtgcccgaattatgatggacttgcacagttgcactagcttgcgttgcttgaacttggacatctaatcgattttaatnnnattgcttcagaaaaccagctgctnctgctgctgcaaatgctaaagatcaagctggctttgttggacaccgtccagtcaccaggtttgcaagctataacanctcacttctgctactttancancttggatcgaattgccatatatgtatcaggttaatgnagtaatatgtcttgctatttttnccccaggaaattcgctgcaacattggcaanccaacctacagttgcccttctggtaatggtcgttaaagatactcaaattgttgctagttcgatagtgcctgctctgctgtttgcttctgtaaacctccccattatggcattannnnnnnnngaactgctgccacctagatagtttctgcttcttcgaatggtaaatacggcaattcaaacactcnnncatncagtggtgtgaaagngaattcagatttttatttgcncgcatagcatatcaatgcttgatatatttgaatgtgatgcactatgnttttgctgttagtttgttcattcctgagtgggtggtaaatgtagccattcaaatatgtggccggtgaagtgtgaaagggcaccaacccatggacttngnacttgtatatttgaagtcctttatatatagncattcaaataaanncagcttctgcatatagtatataaagctttgatcttctaacttgtgctgactgcccttgtatgttgtgtacatttgaatatgcatatatagaatttgaatattctacgatttttcctcttattctaggccttgctgttcacatagccggccaaatttctttcagttcacatctccacattactacactaacatccgaccttgtttcaacaagtnntantnnnnanncaacagctcagatatttaattgttgtgcaggacccaattggaagtgaaagactgaaaagaaacgctgatacggcatttcacacacctgcagatatggaangcacaaaaatgacagatgacagtcccttgcctatgntgtcggagatggatgaaatggtaagttgacatnnnnnnncccttgataaccagaacatntntagtntatttggtaattgtcnnngatacaagtattttcanntgagtcctgnnnnnnnagagatcgagatngnagatattnnngagnnnncac

SEQ ID NO: 811 - DNA, 687 bp, Zea mays
tttatgcaagcaggaggtgtacttgagatcatggaaggcaattgagcagggacttcttgtgaaaggattagagatttttggaaggaacaggttgggtctttctcctaatatccaactctagatagctcatagtgatcagattggtgttccttgcacaaggaacttaggaaatttgtttcccttgatctccaaatttcttgaaattaacctttgtactgtaaatttgtttcccttgatctctttaccttgtgacaccacataaacgtatccgagatctttgtactgtaattgtaaaaaaacaatttaatcttggtttacctaatcttaatagttacaatgaacccatggtttgtctttcacacagttgtttaattgctcggaaccttcttggtggaatgaagacgtgcaaagatgtttttcaatatatgaattatattgaaaacaacagtgcctctggagctcttagtggtgttgattctcttgtcaaaggatatattaaggttggatgcactgtgacccttatttgttgatacttacattcaagccggtaacttaatttggtgttgtccgtgttgatgtcccagggtactgagttgcgcacaagatcaagatattttagaaggcgaggtaaagtccgtcgtttgaagtacacctggaaatctgcaggttacaatttcaaaaggatta

SEQ ID NO: 812 - DNA, 324 bp, Zea mays
acagatgaaccgtgtgctataattgtgagcagtaacatttctacttgctcaaattagtcagtacatgcgtatcaactactatacatcgatgtggttcctacaagctgggctctccattgctttgtgattgctcgctctgacacaaaacaccgaaaagcatacgcaccgcaagccttgtgacatctcaagcgacaaacagctcggcctggccgtcaatgaacaagctcatgaactcctccccgtccacggtctccttctcgatcaggagctgggcgagcttgtggaggatgtcgatgtgcgtggtgattatctgcctgcttctag

SEQ ID NO: 813 - DNA, 616 bp, Zea mays
  misc_feature (10)..(10): n is a, c, g, or t
  misc_feature (77)..(78): n is a, c, g, or t
  misc_feature (94)..(94): n is a, c, g, or t
  misc_feature (111)..(112): n is a, c, g, or t
  misc_feature (118)..(118): n is a, c, g, or t
  misc_feature (262)..(263): n is a, c, g, or t
  misc_feature (283)..(283): n is a, c, g, or t
  misc_feature (307)..(307): n is a, c, g, or t
  misc_feature (350)..(350): n is a, c, g, or t
  misc_feature (386)..(386): n is a, c, g, or t
  misc_feature (405)..(405): n is a, c, g, or t
  misc_feature (409)..(409): n is a, c, g, or t
  misc_feature (448)..(448): n is a, c, g, or t
  misc_feature (527)..(527): n is a, c, g, or t
  misc_feature (575)..(575): n is a, c, g, or t
  unsure (1)..(616): unsure at all n locations
acagtaaatncaccctccttatggaaaaaggttgcagaggcacaattcaaccattcagacatgaatgtaaataagannacaaattcggaaaaangtgaaatcttagagcannggaagntcatgaaaccatcagttgttgatttgtttcaacatcttgtcatcctcgcatttgcttaaaaatatgctagcctaacctagttcgtatggaactgtttgttcctctgtgttggaattagaaattgacagatacacaccaagttannatatggatgaaaggaaaaancatgttcaaaagtcaaaactatgnctaaccttaaccatgttctacccagctcaggctatgaatatgnttaaatcaagtctactagaaaataacacacgacacngttatgagaatcgtgaatntagntatcttccgccttattttcttaagaactggaatactgancatgtccaacttagtcaatgaagtacatatggatcgttgtagttttgcatcgttcaaaccgacaacttattttcagaantacaccagcagactaagagaggcatgtttaccttgccgcttcagaacngagctcgctagaggagcggtgtccttgcttgcactaaggga

SEQ ID NO: 814 - DNA, 616 bp, Zea mays; identical to SEQ ID NO: 813
  misc_feature (10)..(10): n is a, c, g, or t
  misc_feature (77)..(78): n is a, c, g, or t
  misc_feature (94)..(94): n is a, c, g, or t
  misc_feature (111)..(112): n is a, c, g, or t
  misc_feature (118)..(118): n is a, c, g, or t
  misc_feature (262)..(263): n is a, c, g, or t
  misc_feature (283)..(283): n is a, c, g, or t
  misc_feature (307)..(307): n is a, c, g, or t
  misc_feature (350)..(350): n is a, c, g, or t
  misc_feature (386)..(386): n is a, c, g, or t
  misc_feature (405)..(405): n is a, c, g, or t
  misc_feature (409)..(409): n is a, c, g, or t
  misc_feature (448)..(448): n is a, c, g, or t
  misc_feature (527)..(527): n is a, c, g, or t
  misc_feature (575)..(575): n is a, c, g, or t
  unsure (1)..(616): unsure at all n locations

SEQ ID NO: 815 - DNA, 822 bp, Zea mays
  misc_feature (54)..(54): n is a, c, g, or t
  misc_feature (69)..(69): n is a, c, g, or t
  misc_feature (84)..(84): n is a, c, g, or t
  misc_feature (115)..(115): n is a, c, g, or t
  misc_feature (226)..(226): n is a, c, g, or t
  misc_feature (232)..(232): n is a, c, g, or t
  misc_feature (250)..(250): n is a, c, g, or t
  misc_feature (258)..(258): n is a, c, g, or t
  misc_feature (272)..(272): n is a, c, g, or t
  misc_feature (276)..(276): n is a, c, g, or t
  misc_feature (301)..(301): n is a, c, g, or t
  misc_feature (359)..(359): n is a, c, g, or t
  misc_feature (482)..(482): n is a, c, g, or t
  misc_feature (636)..(636): n is a, c, g, or t
  misc_feature (638)..(638): n is a, c, g, or t
  misc_feature (675)..(684): n is a, c, g, or t
  misc_feature (738)..(738): n is a, c, g, or t
  misc_feature (798)..(798): n is a, c, g, or t
  unsure (1)..(822): unsure at all n locations
tgttatttatggcctgaatcttctttttacggtatttcagttatcttgattccncagttattgaaatanaaaagttagaaattngggagacaaaagagtagtgtctgcaattgtncatgcattgttgtcatcctattactacattttatggagtatgcggtttgagagttgctgtttaaaaaagtaaccactattgtactcacaatgatgttatcttcaaaacagncatacnaatctgagcaagaccttnaatattgncatgaaatgagttnaagnggtgcttataactatatatgttaangaatattcttgctatttaggtcttgattggataaacatctcaagaaaaaccaaccttntctgatgattatccttctttgcgtgttatctaatgtttacattgcaacttgcagcaaccaaacgacgaggatcctctgaaccacgaagctgcagttgtccttcgcgacaatccaaagatgttngaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaantncttctggaagcaaaatccaaaccgttcatggtgtgannnnnnnnnncatctgtttgcccgcctttgtgatgtgtggtatagtggtggtgcataatgacanggaaatgcttctctaactgtatcattcattccataaatcctaaacgaggaatgggaagtngattgttaagcagattccttctgc

SEQ ID NO: 816 - DNA, 866 bp, Zea mays
  misc_feature (7)..(13): n is a, c, g, or t
  misc_feature (16)..(18): n is a, c, g, or t
  misc_feature (394)..(394): n is a, c, g, or t
  unsure (1)..(866): unsure at all n locations
gcctgcnnnnnnncannnactggtttttccaggccaccatctcttagttcagatgatagtgcctgggcttggcatgaggctgatgttatacgagttgttgatgatgtagctaatggtattccatctacatacacaaatggtgtatcatcaccaccctccactccatcttgttctcaaaatgaatctttggatccagctgctcacttgataacagggaatgagatcaataatgaagctctgacttctccatcttcggtgcaagatagtcctgaagataaaataacgcaagttgcaaaggctgtgtcttgtggcagtgaagtagttaaggcagatacattgccatatgccatgctgcggccgatagttgttcctagtatatcacgaaggtcatcangatctgagattaagggtgctcatgatcacaggaggagcccatgtgtaccatcaacaaggagggacatacctattctaagaagacctccatcaccagtagtacttagtgttcctcgcgtacctaggccaccacctccttcacctgctggagagtcaagaaaacgagggttccctatcgttagatccggcagctcaagtcctcgacattgggggatgagaggtttattttctgaagacaaaatttttcatagggctcagttttgctcggatggtcctgaagttgtatggccttcatggggtaacaagggtacttctggtacattggtgcaaacaattgaggatactgttttgcaggaccaccttgttaagatttcacagctatcttgtgatcaacatgtaagggtgtagtttcaaatcatccctcaatagtgagaatgattgtttattcaacttttctgtctttctaaaatata

SEQ ID NO: 817 - DNA, 498 bp, Zea mays
caggagcctgaggcggcggtggccatggctcagcacctactggtagctgctgacaggtaaggtttcttttaatcttattttttttcactcacagaagaacaggcgcatatggaagcaacaatatatatatgacgacaattactgtgtgtatagtgtatactagtagattgtaattagctcctaacaattttgacaggtatgggctgaacagactgaagctcatgtgcgaatgcaagctctctggcggcatcgacatcggcacagcggccgcgacgttggctctcgccgagcagcacaactgctcgctgctcaaagccaagtgccttgagttcgtcaccaggtcgcctgagactctcgatgctatcctggcgactgacggctacgagcatctggtggcaagctgcccctcggtgctggctgaactgctgagggctgcgcgtggaaggaagatctgagctggacgatgatttcatattatggtttgcctaagatgtgtgt

SEQ ID NO: 818 - DNA, 884 bp, Zea mays
  misc_feature (516)..(516): n is a, c, g, or t
  misc_feature (547)..(612): n is a, c, g, or t
  misc_feature (622)..(622): n is a, c, g, or t
  misc_feature (767)..(768): n is a, c, g, or t
  misc_feature (785)..(785): n is a, c, g, or t
  misc_feature (849)..(849): n is a, c, g, or t
  unsure (1)..(884): unsure at all n locations
cgcctcggctaacctctccagcctataaagcatcatcctatgagcctgtactttccttccccattgctactcgcgccttccccactctcgtgctgcctcgctctctgctcatttctgttctgctagcgccattctttgtcgcaccgtcgccggggtatccctgtgctgtgccgtgcatcgctcagcatgtccatcgtcgtttctccctcaccggtgccgagccctcgccgaagctccaccaccgtgctgccataattccctgctcacgcccttctctattgctattaccctgcattggctactcgcccatgtctgcaccacaccatgctgttacgctcgctaaacatcctgccggtacgtgccgtattgcccacgcggcatgccattgccgatgcagctcgctgtcgttgtgcttaagccatcaatgccttatttcgcttgttgcccagcccagctcaccctgcagcaaacccatttgaccacaatgatccatttgccatgtcaaacagctttgcnccaccatcaaatgtgcagttagctatgatgnnnnnnnnnnnnnnnnnnnnnnnnnnnnnnnnnnnnnnnnnnnnnnnnnnnnnnnnnnnnnnnnnnatggtgatgntgccgcctcaaacataccagcagcagtcgcagtattctgccccttctcaatctggattatccaatccttttggtgatccattcagtagcctcgtcacgatggctaatccaccaaagcaaagcaattcaaatttagtctgaattgnntttttttttgtgtctantgctcccactaattcagaccatacacaacattgacaattttgaggagcaacttgtacagttcanaaactttgaatactgtatcttaacgatgcgctgta

SEQ ID NO: 819 - DNA, 1295 bp, Zea mays
  misc_feature (670)..(670): n is a, c, g, or t
  misc_feature (695)..(695): n is a, c, g, or t
  unsure (1)..(1295): unsure at all n locations
tcttgggtgttgtatttgcagttgctgagctccgaggtttctctttcaaatccagacatgctcgaatcggtgcagtagcattgacattcgcatctatgcagctagtaaatgcgtatcttcgaccgcataaaacagagaatggagagaccccgcctggaaacagagtagtttgggaatatctccatgttttgaccgggagatctgctgcgcttgctggtaccttggcgctctttactggcttgcagcatcttgggcaccgatatggcagtaagactatcaagggacttacatgcgggctaatcttatgggttataagtgttactttgttaacagcttactttgagtatatggcaattaagcgaaggacagcaggtgttgatggtctttcaggaaattgggtgcttggcaacactgaggaagatgatacagtcgaacttttgcaatctaacagggtagtcagtaaaatggagtctaatttgtcacctgaaccaatggaagtacagctcgagccacttaaaggatgagataaaattctcagcatgcatatggacataaaagtatgttaactaaaattctttatagatagaacgagcggcatatacgtctcaggataaaagaagtttcagtttcgcattttttgttgatataaagggaatattagtgagaatcncatctttgacttgctcgagaggtantatcatgccacatggtatagataggtttttcttatgtcttgtggagcttaggtcctcgtctttaatctcctaacttcttagcaacaatctatgtatacctgtacaattttggtatagttatcataattcataactgaaaagaggatacagtttttttctttctttaaatgtcacatgactcgagcattttcacatatggtactagctgacattatttgtttgtcatatgttgtgtatgtaaattatgtgacttggaactagaaacagccatccaacgaaaccacagtgctcctacattttctaaaatcagttatccacattttatatgtaggctacagttatcctttgtgctaacttttgccttcttaataccaaacctgtggcaatctatgccaacctgatgcattgggccatgtttggtaccaactgaaaggggctcaatgttgtgttgatctgcatcttggtatacctttgtacctgatttcatgatatgtcatgccaaaataccagaaatgcatttacttataaactacatattcatgtctgccttttatctgcaaaagctgctatgacacgcaggagaaagtagttgcccacttg

SEQ ID NO: 820 - DNA, 448 bp, Zea mays
aaggtcgattgcagatgtcctgattcctgaagttgcttcatattgaaggatatcgtttgaactcattatctcaataataatcaaaggcttgctcttgtagataaatgtatcattagagtatcatggctggcccacatattactttcaagaacgtcttggaaaatgttcagatatgcacacttgctgaagtttaagcatttctgaggtagcaaattctttggaagaaaatcagatacccaccttggctcaaataatcctttatgcagttggaagtgtgttacttcgctgctagaaaactcagtgcttgttcttttttaatcttcaaactgctaattatatatttactactacttttacagtgtggaaggatagcaagcttcaactgcaagaacggaatcgacttggagcaggtaacctggccagaaatgggtgttcatggagcaaggca

SEQ ID NO: 821 - DNA, 956 bp, Zea mays
  misc_feature (496)..(496): n is a, c, g, or t
  misc_feature (542)..(542): n is a, c, g, or t
  misc_feature (608)..(608): n is a, c, g, or t
  misc_feature (947)..(953): n is a, c, g, or t
  unsure (1)..(956): unsure at all n locations
accatgaaatggttatatcacagttaatatcttccattgcagacaccattgaaacaggaacaaatttctcttcatccgcatacacaaccaaattaagctcatatgcagacaaggataaaatttactcaccagattggaatgaattccacctcaagcaccgtgcctagctcaaactgggaaagatgaatgctccctatagatccggtctacacccaagattcctcagcctttattagacggggacgcgacgacctgagcacgattgaatcaaggcgagggaagaaggcgacgacgggggctgtacacgacggcgaggtcgcaagggcacgagaaccccaatcgggagagtgtgggagcgggagggcgcgagatgtacacgacggtgaggatgcaaaggtaaaggcgcagaaaccagagcgagagcgcgcaggcatgggaacagagggggagggcgtgggtgggaggagggtgggatagcgcgtcggcctggggatgncgagtcctgactcccgaggactagccaaacattgctagcgaccggnacgcgatgccgagcaagatgcaatggtgagctagaagacgagcctgttggaagccgttgcatgggnttttctttttctttttacccagcctgttggaaaacgagcaagaagatgcaatgtctgtttatccagcctgatggatgctctaatggaggaggaatcgctatttaaaatttaaataacaatgagattgttccctatatatcctctttaattcccttgctattcaattacggttaacaagggaattttaacgcttcaattatctttgttccacttattttaacgcttcaattcccttgctaatcgggcctgagctctgtcaatagtgagcaatggtgagtgatttccaatcacacaatacacgatgctatttcgtttctattctgtcgaccgtcggctctnnnnnnntat

SEQ ID NO: 822 - DNA, 413 bp, Zea mays
  misc_feature (38)..(38): n is a, c, g, or t
  misc_feature (173)..(179): n is a, c, g, or t
  misc_feature (319)..(319): n is a, c, g, or t
  misc_feature (369)..(369): n is a, c, g, or t
  unsure (1)..(413): unsure at all n locations
aaatccgtagtcaactcaactgtggtatggaaacaaanaaaactatcaaaagcaatagcaagtataaatataaagacatgaagcttccctagtaccttgacaagttaagtggaaacatagcatttcctgaaacacatgtattattgcaacgccttatattgcacagcactagnnnnnnngacacaacacatcaaaaagtgcaggaaagttattttaattgaaccacgtcctgtttgtgtgtatgcccatatgctaggtccatagaaattgcacatgtaacaactaacaagcatgttttgcagacaaggctcttacttgnaaattcatcatagtttttcaagaatgctttacatgtacaatcagtgcgancaatagggtagtgtaactacaaacattcaataattacttctaat

SEQ ID NO: 823 - DNA, 453 bp, Zea mays
accgggcgcggcgagttgagtgctgaggcgtgcggctccaggcatggagcaacgatgtcgacaccatggcttcgccggaagaacgagagacagtgcagtagactggtagcgtttggacttcgatcctcatcctcctgtctgcgtgtctcggaatctctagaaacaaatttccgcgtagcctttcacctaaatataaaacttgaattccatatagtacatctgaaccgagtttgaatttcatatagtacatccgaaccgatcaacaaacttgaatttcacttttagtatattcgaaggtcaagacatcgtcgggggtgtaccggctctacacgcggtccgacaaaatggagactgaaactggcaatcgctatcatgaccacatgacactgcccttgccaatcatcctcttattgaaccgtgatagattaaccagtgaaaccagttcatcaatac

SEQ ID NO: 824 - DNA, 447 bp, Zea mays
  misc_feature (85)..(85): n is a, c, g, or t
  misc_feature (88)..(88): n is a, c, g, or t
  misc_feature (418)..(419): n is a, c, g, or t
  misc_feature (421)..(421): n is a, c, g, or t
  misc_feature (426)..(426): n is a, c, g, or t
  unsure (1)..(447): unsure at all n locations
aagaacaagaagtacttctctgtagaaaggattcagcgcaaaaagagagatatcacacaacttctcagtaaacataagcatacanttntggaagataaagtagaggttgtaccaaaacaaccaactgttcttgatctcttcaccaagtctttacatgagaaggatggctgtgaagttctaagcagaaagctcttcaagttcggcgataaagagatactggttaggatccttgacagatatcctttgcatttcccgcccttgcttccaccaggctaatcaagcttctctcttcttaaggcaatttctaccaaggttcaaaataaaacagaagttcacttggcaacaaaccataccgacccacttattcttcactggtctttggcaaaaaatgctggagaatggaaggtaaaactccaanntnttttncatttgttaaagctgcaagca

SEQ ID NO: 825 - DNA, 1427 bp, Zea mays
  misc_feature (350)..(352): n is a, c, g, or t
  misc_feature (416)..(419): n is a, c, g, or t
  misc_feature (450)..(452): n is a, c, g, or t
  misc_feature (460)..(465): n is a, c, g, or t
  misc_feature (475)..(476): n is a, c, g, or t
  misc_feature (482)..(483): n is a, c, g, or t
  misc_feature (485)..(486): n is a, c, g, or t
  misc_feature (490)..(503): n is a, c, g, or t
  misc_feature (507)..(509): n is a, c, g, or t
  misc_feature (511)..(511): n is a, c, g, or t
  misc_feature (518)..(522): n is a, c, g, or t
  misc_feature (527)..(541): n is a, c, g, or t
  misc_feature (546)..(671): n is a, c, g, or t
  misc_feature (673)..(673): n is a, c, g, or t
  misc_feature (677)..(684): n is a, c, g, or t
  misc_feature (686)..(692): n is a, c, g, or t
  misc_feature (698)..(700): n is a, c, g, or t
  misc_feature (702)..(702): n is a, c, g, or t
  misc_feature (716)..(730): n is a, c, g, or t
  misc_feature (738)..(746): n is a, c, g, or t
  misc_feature (759)..(762): n is a, c, g, or t
  misc_feature (766)..(766): n is a, c, g, or t
  misc_feature (771)..(775): n is a, c, g, or t
  misc_feature (830)..(832): n is a, c, g, or t
  misc_feature (860)..(862): n is a, c, g, or t
  misc_feature (1418)..(1423): n is a, c, g, or t
  unsure (1)..(1427): unsure at all n locations
cagctgcacacatactagccttgtgaatgatgggcggcggtattttcataacatgactcatgtatacagtataagccctaggattgagcattatggttgtatggttgacctgttgagtcgtgcgggattgctggaggaggctcatcagctgattggtgacatgccaatgctggcaaatgccgttgtatggggagcacgcctcggtggttgcaagatccatcggaatgctgaccttgctgaatatgtgctgaagcagctcacccgactggagccatggaattctgggaactatgtcatgctttctaacatttactcgaacagtggaagatgggaagatgctgcaaagcttnnnttggaaatgaaggcaaaggggattgagaaggtcgctgcctctagctgggttgagcttgatgatnnnntccacaagttctatgttggggacgattcacnnnctctttcnnnnnngatctatgcnnagcttnntnnattnnnnnnnnnnnnnncttnnngnttgagcnnnnngcagnnnnnnnnnnnnnnnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnacgnnnnnnnntnnnnnnntcagcnnncngctgtccgctcgtnnnnnnnnnnnnnnnaggtactnnnnnnnnnactagatgcatgnnnntttnattcnnnnncatttatcatcagaatgtcataatattgtaggtccaaattatcgtctctagtagnnnaacgccggtaaattatgtcaatcatgcnnnaaccgccgtgcttactattttttttactttaagtatatataatcttaggaaatactgttgtcctaccatgaatagcgctctggtgactagctaaacatgctattagaatataataaataatatatcgatctactatatctatatgtgtgcaatctgttttatatatattttagattacatatatttaaactatacttatattgtattctgtgctggtttgtcaggttgtgtctcccaaatatcttgcctttttgttgcattggactcttctgtggttagaatggcagcacccaagcccatttctcgtcttatttctcacgtcattcttgatttggatggcaccctcttaaacacaggtgacttaaaacttggaaacaactatgattaatggttttttgaggtttagtgtactgaattcacctatctgagctgacttcgattctcttgtcgactctatgtggcagattctgttgtaagtaaggtagtaaaaccatttattctaaagaatggaaaaacgtgggatagcaagaaagctcacaagctagttgggaagacnnnnnntgaa

SEQ ID NO: 826 - DNA, 1097 bp, Zea mays
ttgcatgcctgcagatgtggtgcaagagaggataaattcagccactgaaagatcaatgcccaaatctgtctcgaaaaaacacagccaaccaagatgtgctgaatggtctcgtccgtttgatcacaaaaggtacaggccatggggtgtggaagcccccacttagtgagacgattcacagtccagcaacagttattctttgcaagccacaagaagaatttacactttagaggtgcccggctcttccatatcctcttccaaggtcgaaacttaacaaagcccaagacgaaagcataatatgccgactgctgtagcaaccagactgggtgagcttccaccagtgctggtccggcacatcctgttgaagaaccaccccacccaccaaatcccaaaccagcaggtaatcagccaacgcccgcacagtcagggccgctcttatgtcagaaacccaggcttgattgagaagagcctggaccacagtcctacttttaattgccctttttggaatcactttgaaaagagagagggctacctcagccaaattttttccttcaagccacgtatcagtccagaaatatgttgattttccatctcccacaacagagataaacgccatattgaacagggccctagcctttggcgggacagaaataggaaggccagcccaaggcctacttggatctgttttttgagcccagagccagcgaattctcagggcccagccaagtacttcgaggttgtgaatgcccagaccaccaaactccaaaggacgctgaacccttgcccatgacaccagacaatttctttcattggcatgctcctgttctttccaaaggaaacccttacgccttttgtcaatagcttttaacacccattttggaaggtcaagagcaatcaaatgatggattggggtggcagtcagaaccgtccgtaccataacaaggtgtccagccttattcattaggggggccttccaacccgggagatgatctgcaattttatcaatacgaggcatgaccccattcttgttggtgtatggatacatagtggcagcccaagataagtgcagggaaactccttaatctgacatgacagcacat

SEQ ID NO: 827 - DNA, 645 bp, Zea mays
  misc_feature (1)..(2): n is a, c, g, or t
  misc_feature (13)..(14): n is a, c, g, or t
  misc_feature (335)..(335): n is a, c, g, or t
  misc_feature (367)..(367): n is a, c, g, or t
  misc_feature (372)..(372): n is a, c, g, or t
  misc_feature (441)..(441): n is a, c, g, or t
  misc_feature (575)..(576): n is a, c, g, or t
  misc_feature (599)..(599): n is a, c, g, or t
  misc_feature (602)..(604): n is a, c, g, or t
  misc_feature (610)..(612): n is a, c, g, or t
  misc_feature (628)..(628): n is a, c, g, or t
  misc_feature (630)..(632): n is a, c, g, or t
  unsure (1)..(645): unsure at all n locations
nntgcctgcagcnnagtagctcaagtacatcaaattcaatctaaaaggaagtgcagcaaatggcataagagcatgtgtgactgagtgcaaaagcgggaagagaagcttcgacggcagcaaatggcatacgagcatgtttgagacatgttttatcatcaaaagcggcaagagaagcagtgcctcacacctcttgtccgggcgaagggctccccaatgcaaaatcagggaaccgcttgtgttggtcacctccaggctaatctctgacaccaaaccctgcggcgctgggttcactgcaacctgttcccacacaatgcaccaatagtgttatagagatnaaaatcgtagcagatgggtgaatgaacctggnatccngcggtcgcacctggagctcggagttggaatccagcgtgaactttccgataagctgcgacaagagcaacngaaagacatgaaaatgaagcaggcaaattgccaaacagtgggagaacatcagctgatgatggcccagcggcgaaagatagagcaggcatgaggtgcttacgtcgggggacgcgcggtccgcggacgtggcgacnncgcgcggcacgacggggccgcgnctnnnggcggnnngcgtcgtggggcggcncnnncccccgctgcgtc

SEQ ID NO: 828 - DNA, 798 bp, Zea mays
  misc_feature (606)..(607): n is a, c, g, or t
  misc_feature (625)..(627): n is a, c, g, or t
  misc_feature (677)..(678): n is a, c, g, or t
  misc_feature (681)..(681): n is a, c, g, or t
  misc_feature (685)..(687): n is a, c, g, or t
  misc_feature (704)..(705): n is a, c, g, or t
  misc_feature (708)..(795): n is a, c, g, or t
  unsure (1)..(798): unsure at all n locations
agaaacagtagttcgaggtagcacaggcagttgagatggagtaatttggacccatgaaaccaatgtccattccaagcagggcagaacccatgtttgtgatagcatatgggatgaagaaaggagttatctttctgtatcccttctcaatgagattctggacaccatccgaaaacaccgtgaggccacccataccagtgcccacaagcacaccggcccgggtcttgtcaatctgccagagagaatattttaccaattagcatcaaatgtagcattaacagtgaaaaaatcttatagtactagtaaaaatatcaaactaccagatgaaactactatcaatacagtacaaaccatagtttgatgtgctagaagacaatttgatttaatccaaaaatgctactccctctgacctgtagggcgtgtttattttgaagaaaccaaactcgtaaacccaaccaacaattagtcaaattatgtgtgtttggagtacaaaagctatatcaacagatttatactcaaacaacttttaatgcgacattgattttgcagagactagcaatattataaaacaataatggttaaaatatgcttctaatgacactatccgtnnacaatatgcctggaaaannntagtactttgctagaaaaatcaccataatgcaagtgaatcatcaaacganncancagnnnttcgcagagctatgttnntannnnnnnnnnnnnnnnnnnnnnnnnnnnnnnnnnnnnnnnnnnnnnnnnnnnnnnnnnnnnnnnnnnnnnnnnnnnnnnnnnnnnnnncga

SEQ ID NO: 829 - DNA, 1056 bp, Zea mays
ggttgcagctgtgctttagctaaagcgaacgccgtgtatgttttttttttctggtcaactaaacattgttgtgtatacatacataaacagcaatcgaagcagacaataggcaacaaaataacgaattaatgctgttatcaaatgagccagcaacggataaacttgagatgctgccctagtagccgttctcaaactgaagccctcaaggcttcaaacccatcaattgcttgcaactccagccacaatcatactaataattacacttgagcgcagccaaaatagcaataaaaaagttgagcaaagagtgcacctgctttgcttaattgctctgcacgctcacgacgtccaaccgacgctacagcctacagcggcgtgaaaaaagaagagctgttttttaactccacacacggaacaggaattaccaaccgaccgacccagtgtacccgattcggaccagatcttcgtggaattcaccagatctatctagagaagaaacagggaaacaggaaaccagtaccttcccgccggtcgatgagctgatacgtagcgcgctcaggcgactggcccatggggcggctggcctcaggcggggcaagctaaaaagagccctcccgcccgccgcggttcgggctctccttcctgaacaaggtcgagttcggctccggatccggctgggccacggggaagtcggaggcggacgggtgcggacggagacgggggcggagaggtgggggtgagcggacagagcgaagatgggcgtggtcgctgtggatggaggcgaggcgggtgggtgggtggacgggtgaggccgtgagctgaggtgaaggcgaggtgaggtgagggagatggggtggtggagtttgacccgacgcggcggggggtggccgggtggggcccgcgcggccagtgtagggcgcggtggcgtcgaggggaagggtgcggcgcggtgggtggcggccagcctcgggatccgggtccagcacgggcgcacgcgcacctggcgatcggatgggcgtcggccgatacgaatatgcacgcgcacctggcgatccgggt

SEQ ID NO: 830 - DNA, 689 bp, Zea mays
  misc_feature (19)..(19): n is a, c, g, or t
  misc_feature (79)..(79): n is a, c, g, or t
  misc_feature (462)..(462): n is a, c, g, or t
  misc_feature (472)..(472): n is a, c, g, or t
  misc_feature (592)..(592): n is a, c, g, or t
  misc_feature (634)..(636): n is a, c, g, or t
  misc_feature (644)..(652): n is a, c, g, or t
  misc_feature (660)..(664): n is a, c, g, or t
  unsure (1)..(689): unsure at all n locations
tgcagctctactaacacanctgtgacttcagattggacatgagagagaaactgctatttgtctgatgcaaaagttcatngatcggtcagaccttcagataaagtcagtcgtggcattggatcatcttaaaaattatatttatgttgaagctgaaaaggaggcccatgtcaaagaggtaagcatgcctacgtgtgattgacattttacctctgatttcattccttcttgctaaatttggtctatgcaggcttgcaaaggtctaagaaacatttatgcttcagcaaaaataacattagtgccgataaaagaaatggcagatgtcctctccgttgagagcaaatctgttgatctttcaagggattcttgggttcgaatgaaattgggcatatataaaggcgaccttgctaaggtattaccacaacacttctcttataaatatagtatacaattcttaaaatgttnatttgatcgngttttgcaggttgttgatgttgataatgtacgtcaaagagtagacgtgaagctgatccctagaatagatctacaagctttggctagtaaacttgtaagttttagcctttgtttctcacangagcagtgctacaagtacaactatttgggtacaacttgagtnnnaaagaccnnnnnnnnnaaatgacnnnnntaaaaagctcatagatgcattgatc

SEQ ID NO: 831 - DNA, 489 bp, Zea mays
  misc_feature (198)..(198): n is a, c, g, or t
  misc_feature (267)..(267): n is a, c, g, or t
  misc_feature (281)..(281): n is a, c, g, or t
  misc_feature (296)..(296): n is a, c, g, or t
  misc_feature (322)..(322): n is a, c, g, or t
  misc_feature (420)..(420): n is a, c, g, or t
  misc_feature (443)..(443): n is a, c, g, or t
  unsure (1)..(489): unsure at all n locations
agacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctcccgaaccaagccctctcccactgctaccaccttccttcnttgtacccggattatttcgtgtaaagatcacatgtgatcctaagaattaaaacgtgagtcgttttagcntatattgtgaagcncgtgctggcaagttnccgttcttggcattgggtcaaattgnggtgccctgcttccgattccctgctgcaccgtgcctatgtagcatgtaaagttgtatatgctgcgaatcgtagtacagctatatatttgtgtgtcctnaatcttgagtgtctttttactgncttctgtaaatgctccccaactgatgtaaatacaaaattccatgtt

SEQ ID NO: 832 - DNA, 775 bp, Zea mays
  misc_feature (13)..(13): n is a, c, g, or t
  misc_feature (20)..(20): n is a, c, g, or t
  misc_feature (32)..(32): n is a, c, g, or t
  misc_feature (182)..(182): n is a, c, g, or t
  misc_feature (232)..(232): n is a, c, g, or t
  misc_feature (259)..(259): n is a, c, g, or t
  misc_feature (548)..(548): n is a, c, g, or t
  misc_feature (597)..(599): n is a, c, g, or t
  misc_feature (601)..(603): n is a, c, g, or t
  misc_feature (611)..(611): n is a, c, g, or t
  misc_feature (638)..(640): n is a, c, g, or t
  misc_feature (647)..(681): n is a, c, g, or t
  misc_feature (684)..(698): n is a, c, g, or t
  misc_feature (700)..(774): n is a, c, g, or t
  unsure (1)..(775): unsure at all n locations
aatcccacccatnttagctnccattactaatntcgttatccacaatttctccctcttttgtcaatcgtgtttggtctgatcaggagagggcgctaaggaagatgtccggatcaccggtgttactgtcaatggaggactcctctactgccaacgttagttttcttcaactggatttgcttganattggtcttgttacaaaatacctgctgttggtgtatcaatttctttgggntttgtgattgcaaagttatcagatgangaggatgatgaaaaattgggcgatgctgatgaagatgctgagagcgagaagctcagccaacctgttgacaatacgtctgataagcctgacgcacccagctgccgccttagatctggtatagaggtttagttcttttcttgttttacatagagccttctatcttttatgttgtgtgctcacttagagttttggtgttgtatacatagatcatcggaaggagaagtcccttgggctcctcactcagaattttgtcaagctcttcctcaacatggaggtgagaggactgaantcaccctgtatggtttgggttatttccctttcgcacttaactgtaatgnnncnnntatttcgnacaggttgggacaatctcacttgacgnnnctgcaannnnnnnnnnnnnnnnnnnnnnnnnnnnnnnnnnnatnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnt

SEQ ID NO: 833 - DNA, 544 bp, Zea mays
  misc_feature (1)..(4): n is a, c, g, or t
  misc_feature (6)..(10): n is a, c, g, or t
  misc_feature (14)..(17): n is a, c, g, or t
  misc_feature (19)..(19): n is a, c, g, or t
  misc_feature (28)..(28): n is a, c, g, or t
  misc_feature (159)..(159): n is a, c, g, or t
  misc_feature (214)..(214): n is a, c, g, or t
  misc_feature (216)..(216): n is a, c, g, or t
  misc_feature (221)..(221): n is a, c, g, or t
  misc_feature (264)..(271): n is a, c, g, or t
  misc_feature (337)..(337): n is a, c, g, or t
  misc_feature (358)..(358): n is a, c, g, or t
  misc_feature (451)..(452): n is a, c, g, or t
  misc_feature (455)..(457): n is a, c, g, or t
  misc_feature (464)..(466): n is a, c, g, or t
  misc_feature (468)..(470): n is a, c, g, or t
  misc_feature (472)..(474): n is a, c, g, or t
  misc_feature (476)..(477): n is a, c, g, or t
  misc_feature (493)..(512): n is a, c, g, or t
  misc_feature (514)..(518): n is a, c, g, or t
  misc_feature (526)..(528): n is a, c, g, or t
  misc_feature (534)..(538): n is a, c, g, or t
  misc_feature (540)..(542): n is a, c, g, or t
  unsure (1)..(544): unsure at all n locations
nnnnannnnntctnnnnangtcttcgcnctcgtcgttgctgttttcatgtacattgtcgttcacatcttgctgtccttcgacaaaatggcacgggtcatgaagaggactggagaacagtgggttccatgtctgaagaagatgtgggcactcattgaaantgaacctccaaaccatcagccatcttcagaggaaccatgagaggctgacccttgncngtatncttgtattgtgattacatgaattgttcaattgatatgtacctnnnnnnnntagaatcaatatttgttttccccacttgtttaaggttgaagtgttgtaatctttttatgcacttanagataagatgcattcatccangagggttagcttcaagtacttcgttcttggttttaactttctcagtatattggacggccggaactacttatttgtagctacctctagcagtcnntcnnnttattcnnnannnannncnntctaaagtgtataatnnnnnnnnnnnnnnnnnnnnannnnnatatacannntctacnnnnnannncc

SEQ ID NO: 834 - DNA, 427 bp, Zea mays
  misc_feature (11)..(11): n is a, c, g, or t
  misc_feature (19)..(19): n is a, c, g, or t
  misc_feature (96)..(106): n is a, c, g, or t
  misc_feature (113)..(115): n is a, c, g, or t
  misc_feature (339)..(339): n is a, c, g, or t
  misc_feature (352)..(352): n is a, c, g, or t
  misc_feature (391)..(391): n is a, c, g, or t
  misc_feature (419)..(419): n is a, c, g, or t
  unsure (1)..(427): unsure at all n locations
tgatagtacangctacctncctcccaacaactcacgtgtgtgagaactgttttggttgacactgcaaccagccacacgacaacgacgtcacaactnnnnnnnnnnnatcagtnnnaaggtagggtaggggagtaggggacacaaacttgtggaaatcaggaaccccacgacgcaatcaagacgccacggttgctttgacgctggaaataaactcctccatgctccggtagctggtgccaccctctgcaactgccttggccgcttcctcggcggtcctcgtcgtccttgccctgaccgcttcgtcggacatgacctcttttactttcttcgcgatctccnccccggtcaccanccagtcctccccgtcccagctccagtgctccatccacancccaaccccaccgctcaccgctaccttngcgttcaa

SEQ ID NO: 835 - DNA, 487 bp, Zea mays
  misc_feature (95)..(95): n is a, c, g, or t
  misc_feature (105)..(105): n is a, c, g, or t
  misc_feature (119)..(119): n is a, c, g, or t
  misc_feature (126)..(126): n is a, c, g, or t
  misc_feature (151)..(151): n is a, c, g, or t
  misc_feature (170)..(170): n is a, c, g, or t
  misc_feature (172)..(172): n is a, c, g, or t
  misc_feature (189)..(189): n is a, c, g, or t
  misc_feature (197)..(197): n is a, c, g, or t
  misc_feature (202)..(202): n is a, c, g, or t
  misc_feature (232)..(232): n is a, c, g, or t
  misc_feature (238)..(238): n is a, c, g, or t
  misc_feature (253)..(253): n is a, c, g, or t
  misc_feature (256)..(428): n is a, c, g, or t
  misc_feature (454)..(454): n is a, c, g, or t
  unsure (1)..(487): unsure at all n locations
actactgatgccattggctaccatgaacccatggatgcagtactgcatgaagcaacagggggttgccaacttgctagcgtggccgaccctgatgntgcagcaacngttggcctcaccgnttcagcngtgccagatgccaatgatgatgccnggtatgatgccaccgatgncnatgatgccgatgccgantatgatgncatcnatgatggtgccgactatgatgtcaccaatnacgatngctagtatgatgccnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgccacaatgttactctgattcnatctcgcacattatacaacaacaacaattacca

SEQ ID NO: 836 - DNA, 733 bp, Zea mays
  misc_feature (350)..(350): n is a, c, g, or t
  misc_feature (571)..(571): n is a, c, g, or t
  misc_feature (582)..(584): n is a, c, g, or t
  misc_feature (586)..(594): n is a, c, g, or t
  misc_feature (598)..(598): n is a, c, g, or t
  misc_feature (605)..(605): n is a, c, g, or t
  misc_feature (615)..(618): n is a, c, g, or t
  misc_feature (625)..(632): n is a, c, g, or t
  misc_feature (634)..(652): n is a, c, g, or t
  misc_feature (656)..(659): n is a, c, g, or t
  misc_feature (663)..(665): n is a, c, g, or t
  misc_feature (671)..(672): n is a, c, g, or t
  misc_feature (676)..(676): n is a, c, g, or t
  misc_feature (679)..(679): n is a, c, g, or t
  misc_feature (681)..(691): n is a, c, g, or t
  misc_feature (693)..(696): n is a, c, g, or t
  misc_feature (698)..(708): n is a, c, g, or t
  misc_feature (710)..(712): n is a, c, g, or t
  misc_feature (716)..(716): n is a, c, g, or t
  misc_feature (718)..(722): n is a, c, g, or t
  misc_feature (725)..(725): n is a, c, g, or t
  misc_feature (727)..(732): n is a, c, g, or t
  unsure (1)..(733): unsure at all n locations
caagttctgagtttctctcttgtcagtcaatggcttgggtaaaaattgtgaacagagaatatgaaagcctgacaaactagcaatgagtccattttctgaagataaacagcaaggaaaattctgaatcccatgtgtagaaacatgtaggaaacacctttcttgtttatgagtgataggcaaaattttggtcattgcatcctagggttaacttacagtcttcttttgcaggtcaaggacactcccacgaagtgttctgatcatagggacccaagcggtgatgataattacttacctgctctttgcattgggccggctcgccacactttacgtctctgtcgccttactcgggntatgttttggtatctcgctctccgtgataatctcaacctcctcagagctcttcggactaaagcactttggaaagatattcaacttcatcgcattggcgaatccggtaggcgcgttcctgtttaacaccctcgcgggatatgtctacgatctcgaagtggaaaagcagcacgccacaacatcagggtcggacgttgcatgtcatggccctaattgcttcagnctaacattctnnntnnnnnnnnncgtngcatgcntgggcacacnnnngagcacnnnnnnnncnnnnnnnnnnnnnnnnnnntatnnnntgcnnnatgcanncggntcntnnnnnnnnnnnannnncnnnnnnnnnnnannnatgncnnnnnagntnnnnnnt

SEQ ID NO: 837 - DNA, 616 bp, Zea mays
  misc_feature (554)..(555): n is a, c, g, or t
  misc_feature (565)..(566): n is a, c, g, or t
  misc_feature (578)..(578): n is a, c, g, or t
  misc_feature (589)..(593): n is a, c, g, or t
  misc_feature (602)..(602): n is a, c, g, or t
  misc_feature (604)..(612): n is a, c, g, or t
  unsure (1)..(616): unsure at all n locations
atcttaaaagcactgaagttatcgaacatccatatgtccaggtaatagcagttcaactgctccagtttgactaatattccctgttttatttggagtgctaagtctctcttttgctcctattcagatatttaatgaaggacatcaaaatgttcttgtagagatgttggaaatcataacagtaatttgtgaagagctcaaactacccatagctcagacttgggtgccatgcaaataccaaaatttattgatacattgtggtggtgaaaataagagttgcttcgatattcatgaaagttgtgcccaagaactatgcatgtcaacaagtgctgttatgtttcatattatcgatgctcatatgtggggcttccgagatgcctgtgtagagcaccacctgaagaagggacaaggggtttctggaaaggcttttatcctacgtaggccttgctttacgaaagatgttactagattctctaaaatggagtacccccttgttcactatgctcgtatgtttggattagctggctgtttttcgatatgcttgcaaagtgcttatnntagaaatgannactatgtattgnagttcttcttnnnnnctgattgtngnnnnnnnnntgag

SEQ ID NO: 838 - DNA, 711 bp, Zea mays
  misc_feature (73)..(73): n is a, c, g, or t
  misc_feature (527)..(527): n is a, c, g, or t
  misc_feature (555)..(555): n is a, c, g, or t
  misc_feature (559)..(559): n is a, c, g, or t
  misc_feature (578)..(578): n is a, c, g, or t
  misc_feature (589)..(594): n is a, c, g, or t
  misc_feature (606)..(608): n is a, c, g, or t
  misc_feature (610)..(611): n is a, c, g, or t
  misc_feature (613)..(614): n is a, c, g, or t
  misc_feature (616)..(621): n is a, c, g, or t
  misc_feature (625)..(629): n is a, c, g, or t
  misc_feature (631)..(631): n is a, c, g, or t
  misc_feature (633)..(635): n is a, c, g, or t
  misc_feature (638)..(640): n is a, c, g, or t
  misc_feature (643)..(648): n is a, c, g, or t
  misc_feature (652)..(658): n is a, c, g, or t
  misc_feature (661)..(664): n is a, c, g, or t
  misc_feature (666)..(667): n is a, c, g, or t
  misc_feature (670)..(672): n is a, c, g, or t
  misc_feature (674)..(678): n is a, c, g, or t
  misc_feature (705)..(705): n is a, c, g, or t
  misc_feature (707)..(708): n is a, c, g, or t
  unsure (1)..(711): unsure at all n locations
tttatcttatataagcatttcattttgaaatgatccatttcccaatgccgaggcacatgcaaactgttttaanttttatgccttacacggttgttttcagacattatgtgctgtacctatttcaggcaatttcaagacgagccaccttatacaagatgataagggattatgaccaagctgctaatgatgtaaggaagctaatctctcttcttgaaaagaaagtcaatgtgtctggagtatcaccaaaagcttttaacaagcacaatgatctcaagcaagcacatgtgaggctttcatccatagaggatgaagcaaaaaatgacacccccctgaatttgtatttaatcttgtaagttgtccaaattggttttacctttttgttccttcagtatgattttcttgccccagtttgtgcctggttgacctgaatatttgtattccttgaaagcaattattgcttatctctgcatttaattttcacctttcattgtagattttactgacccagacaacaaaaatagcattgnttattatatggatacaagtacaaaatangctntacttagtagccctttaangaactacgctnnnnnntatgtgtgttgnnntnncnntnnnnnncacnnnnnanannnagnnnctnnnnnnaaannnnnnnttnnnngnnctnnntnnnnngcttttaaacatgatattctgatatancnncat

SEQ ID NO: 839 - DNA, 634 bp, Zea mays
  misc_feature (107)..(107): n is a, c, g, or t
  misc_feature (216)..(216): n is a, c, g, or t
  misc_feature (281)..(281): n is a, c, g, or t
  misc_feature (334)..(334): n is a, c, g, or t
  misc_feature (353)..(353): n is a, c, g, or t
  misc_feature (370)..(370): n is a, c, g, or t
  misc_feature (383)..(383): n is a, c, g, or t
  misc_feature (403)..(411): n is a, c, g, or t
  misc_feature (464)..(464): n is a, c, g, or t
  misc_feature (488)..(557): n is a, c, g, or t
  misc_feature (594)..(594): n is a, c, g, or t
  misc_feature (599)..(599): n is a, c, g, or t
  misc_feature (601)..(608): n is a, c, g, or t
  misc_feature (619)..(620): n is a, c, g, or t
  misc_feature (622)..(626): n is a, c, g, or t
  unsure (1)..(634): unsure at all n locations
ttttcaacatgttctgatggctttgatctagaaaatattatgtctttagagttagacaaagcctgtacagtggtatttagctcctgaattcgaaaatttggaccatncttatgtgtattatggttgtcaacactgctcggagtaagaatccctgaagaatgctgaaccagaacatatatagaagaacaagataagtgcaaagacaatgcaaactanatttgaagagtaagattaactgcatttcattctataaactttattactaataagtgaactttttncaccaacccacccttcatgcaacaatcaagaccctggaaacctatatttctantttcccttatatgatcaanaccctggaaccctccgngtgcccccccccntcccccaggcattatatgannnnnnnnntcctttacatttctagtttccttggaaacctgtttttctgtaaagagtgattntttctctcgaacacgcatgagagnnnnnnnnnnnnnnnnnnnnnnnnnnnnnnnnnnnnnnnnnnnnnnnnnnnnnnnnnnnnnnnnnnnnnngcacccacaaacaacacaaacacacacaaaccaatanagctncnnnnnnnntctatgagcanncnnnnncatttggc

SEQ ID NO: 840 - DNA, 634 bp, Zea mays; identical to SEQ ID NO: 839
  misc_feature (107)..(107): n is a, c, g, or t
  misc_feature (216)..(216): n is a, c, g, or t
  misc_feature (281)..(281): n is a, c, g, or t
  misc_feature (334)..(334): n is a, c, g, or t
  misc_feature (353)..(353): n is a, c, g, or t
  misc_feature (370)..(370): n is a, c, g, or t
  misc_feature (383)..(383): n is a, c, g, or t
  misc_feature (403)..(411): n is a, c, g, or t
  misc_feature (464)..(464): n is a, c, g, or t
  misc_feature (488)..(557): n is a, c, g, or t
  misc_feature (594)..(594): n is a, c, g, or t
  misc_feature (599)..(599): n is a, c, g, or t
  misc_feature (601)..(608): n is a, c, g, or t
  misc_feature (619)..(620): n is a, c, g, or t
  misc_feature (622)..(626): n is a, c, g, or t
  unsure (1)..(634): unsure at all n locations

SEQ ID NO: 841 - DNA, 705 bp, Zea mays
  misc_feature (492)..(492): n is a, c, g, or t
  misc_feature (596)..(596): n is a, c, g, or t
  misc_feature (608)..(608): n is a, c, g, or t
  misc_feature (642)..(643): n is a, c, g, or t
  misc_feature (646)..(646): n is a, c, g, or t
  misc_feature (648)..(652): n is a, c, g, or t
  misc_feature (694)..(694): n is a, c, g, or t
  misc_feature (696)..(696): n is a, c, g, or t
  misc_feature (698)..(700): n is a, c, g, or t
  misc_feature (703)..(703): n is a, c, g, or t
  unsure (1)..(705): unsure at all n locations
gctccttttcaagtgccttttgggcgtatatagtagatgggccttatacactttataacatcaatataaatataattgtctcaaattacaaatgctaacacattccttttcttaaagatatgcattacaaatccatgttactacctttcatttatctgaccatatcaacctatcaccaccagattccaaatattaccaacataggtttgacagcacggaaaattaaaaaggcagctatcgttgggggtggtctaatgggatccggaattgcaacaatactgatattgaacaactttaatgttgtcttgaaagaagtaaatgaacagttcttatctgctggcattaacagaattaaaggtacacttttatttgctgcactttttttttggaattgccttcatagttcctcagaagtttgttctcttgtgttcagtgaatttgcaaagtcttgtcagaaagggtcaacttactgaagaagattatgaaaagaanctttctctgctatgtggtgctcttgactatgaacagttcagagatacagatgtagtaattgaggtagacccagtttctattatattcaccactctctgattaanatgagacagcgntgcttattcagctttgtcacctatatagagacanntancnnnnntatatcatgtgcataggtataactagttatgtcttataacancngnnncantc

SEQ ID NO: 842 - DNA, 339 bp, Zea mays
  misc_feature (121)..(123): n is a, c, g, or t
  misc_feature (154)..(154): n is a, c, g, or t
  misc_feature (163)..(163): n is a, c, g, or t
  misc_feature (295)..(296): n is a, c, g, or t
  unsure (1)..(339): unsure at all n locations
agtccagttatatgcttcttcagcagtacattcagaatgagaggttggatttgacagtgaaaagatgataggcctctgcatttataattagcaataccagagattagctttccatcctcannncaacataccaccaacaatgtcagaaaacagnaaaaaaaantcacctcattgaaggaagccatggcctcaacaacttcttttgtgaatgttcttccaactccagacgtcccaatcagaactgtaggtttgatggactggaagatatgagaaaggttagtaaattctttttttnnatggaaacagcacaaacatgacagcttttaagtgaaggcagca

SEQ ID NO: 843 - DNA, 655 bp, Zea mays
  misc_feature (4)..(18): n is a, c, g, or t
  misc_feature (573)..(575): n is a, c, g, or t
  misc_feature (577)..(578): n is a, c, g, or t
  misc_feature (586)..(587): n is a, c, g, or t
  misc_feature (593)..(598): n is a, c, g, or t
  misc_feature (607)..(609): n is a, c, g, or t
  misc_feature (618)..(623): n is a, c, g, or t
  misc_feature (625)..(648): n is a, c, g, or t
  unsure (1)..(655): unsure at all n locations
gtgnnnnnnnnnnnnnnnttggtaactccagctctggagtagaagatggatgtcgagaaggaacatgaaagtagagcatctgtaaagttatcatagaaaactatattcatttttgctctggacacaagagagctatgtattttgtataaattcaagagagaaaagggagaagagtaaagccacaatcattttaagttgccatagagcagaatattaggtggtcacaaaatccaagtgaccatgcagcaacgatggaacagaacaaaactctgtaagagtaaaaattaagagtacacctgtgggatttaaatgataccgaaaccacactttttggaacttattttgtagaactaaacaaactttttttccttcaaaaaaaaagaactaaacaaacttcggccatactatctcaaagctacatgtttgcaaaaaccattaggttggacagcaactgaaaggggtttcaaagcatgtagttttgaactacgttaaagcaactaaactaaaagtacttcatttcatgatattgcaccatgttggttggaaggcaaaagtgcaaggtaacaatggtcnnngnnggtcctgnntgtttnnnnnnaaaaacaannntcgtagctnnnnnncnnnnnnnnnnnnnnnnnnnnnnnnagcctgc

SEQ ID NO: 844 - DNA, 507 bp, Zea mays
tgcgcgtactgggccgcgcccgcgtccggggacgaactgctctcctgggcctgccacacgaccgtgccgtcgtagtcggtgagcaccatgctcccgtccttgcgcagggcgacggccgcgccccaggcgtgcaccgggcggccgcggttggcgctccacacgatggcggccgtgtcgtcgccgtcggtcgaggagttggtgtaccataccgagaaggtgaaggcgccgtcgtagatctggtggaagccgcaggagaaggtgccgtccggtgacgaccgcaggattcgggtcttgtactcctcgacgatgagccgggatttccgtggtatagtgtcatgcggtgcggtataggagaaggcgctggtcatcaggggcaggggtcgtggagcaagcgtggagagggtgatgctggcgagggcaagggcgagagcgagagccgccatgggtgcagggagtggtgtcagagctggcggcgggatgagcattcgtcattgcggttgctcatca

SEQ ID NO: 845 - DNA, 493 bp, Zea mays
  misc_feature (197)..(197): n is a, c, g, or t
  misc_feature (347)..(347): n is a, c, g, or t
  unsure (1)..(493): unsure at all n locations
gatgaactttgctgtgtttatcaatgcttggaacttgtgttctaatgtgtcagtgatccctggaactgacaaaagcagcccaaactcctggtggatcgtggataacctcgtcaaaacttgcatagatgagcagttggctgataccaatcaaattctgacatctccaggaagcaatattccacttctagcgtggatgntgacagagcccatttcctggcaccttcttgtaatccaatcctgtatgagatctatggctccacaagggaagaagaagaagaaaggcgggccatctgagcgaccaaacacacctcacctgcaggcaattcggagctccgttcagtgcatgnctgacactctccagagagtccagaaatgtctgtcagaacagatgaagccagaagagcaagctctagacatgctggtgtcacatttgcaaggaaccggtgccgaaggccctggacagatcgcccgtatcttggacgagagcgcagca

SEQ ID NO: 846 - DNA, 854 bp, Zea mays
  misc_feature (5)..(12): n is a, c, g, or t
  misc_feature (315)..(315): n is a, c, g, or t
  unsure (1)..(854): unsure at all n locations
tgcannnnnnnngctgttaatctcacatcctgctctgtccagaacccttcctcagccatggcataactcaaatcaagaatcttctcaaagagtgtcctcttgtttgacctccactcattcaggaacttgatcaaccgaccaacattcacatgaagatccttctcttctgcaaatgggtatgcctgaatatagtccttcctgtaaatagtaggtggatagaaagccacatatccaccaatctcccacaagatccgttgcgcccagtacccacggatcacatctgctgccattgagctcacagacactggcatcatnagcccccagaaagcaggtgactggaacaatgtattgaacgagttcactggtgccatcatgccctgaggtagtgccaccttcggggcttccgaatcaaacctcagatcgaacgccgaagttggtggttttctagtgaagtagaacaccgcatctacatctggcaacccgtccgacagcccctgctgaatgaattgccggccactgaagacctcggtgtagaacacctcatgggcgacctccccaaccttatcgagcggcagcccccttggccagaccgaccgctggccgaagtgcacgtaggggttcaccactgtgcgattgggatccgcgtggctgtactggagcagcactgggtggttggtgactccagatcccaaatccacgtcgaaatgcttccccagatcgttcccgggcacctcggcgcggtcgtcggcgtcgaagatcaccttggccccgtgctggatggcgaagaggtagcccgccgtcttgcggacgtgggagccgtagggcaggaagtcgacggagcggtatccgagctg

SEQ ID NO: 847 - DNA, 685 bp, Zea mays
  misc_feature (649)..(649): n is a, c, g, or t
  misc_feature (654)..(654): n is a, c, g, or t
  unsure (1)..(685): unsure at all n locations
gagacagtattatgttcttatcttttatgagagcttccagatcagtttccataaactcaaatacaaggtgcaaattttccttgtaagggaaacaatcaatcagctctataatattaggacctttcagctccttaagtagtttaatttccctcaatgcggtgaagttaacaccttccttcttgtccttccctacccagattctctttaccgcgactgtatttccagtctgaaaatgaacagcatccagcaactcatgaacaaaacaggtcaatcagaatgaaaaactactactccctccgttccaaattataagttgttttggtttttctagatacattgttttaattacatatccagttatttttttaaaccaaagaccctacgtctgagtgcatagcaaaagatatgtatctaaaaaattatgtatctagaaaagacaaaatcttataatttggaatgtacagagtacaaaatatgagagaacattaagaacagtcggaaggctgaaccgtggtgattctatcacagccacgtatacttgactgagaaaagtaaaaacggtgatgacaccacttaagaccagtgagaacacatcccacatctgttgtcactcttacacgcgtggaatacataagtccaccaaaaaaantcaancccggtatccaacagaacacgagaactacca

SEQ ID NO: 848 - DNA, 519 bp, Zea mays
  misc_feature (422)..(422): n is a, c, g, or t
  unsure (1)..(519): unsure at all n locations
tgtcaatgcagttttgctggagccagttttcccattccaccaagtgaagggaccatattttccataccattttttttcacctatgagcttgtatagcagtgaatgctccagtgtttcagctatcaagtctatgaaggatatggtcaaaacaatgcacagaaatggaatagaggttctcttggaggttgttttcacgcatactgctgaaggaggggcggagtgtcagatgatatcacttcgaggcatcgatggttcctcgtactacattgctgatggaatcgctggatgcaaggcaagtgtgttgaattgcaaccatccagtgactcagaagctgattttggacagcctccgccattgggtgctcgacttccatgttgatgggttctgcttcatcaatgctcctttcctcgtcagaggtccangtggtgagggcctctcacggcctccacttctggaagccatagcatttgatcctgttctttcaaagactaagatcattgcagatccttggtctccgct

SEQ ID NO: 849 - DNA, 831 bp, Zea mays
agacggccggactgctcctgcgaagacgacgctgacatcgagtacgacagcagccgtatctgggttctggacacgcccaacataccaaagcctccaccagagacggagaggctagtgattatgggcggtgactacaccagaatggacacgtattacgtcatgcccaatgggaagcgtgcgaggtgtgctggtgacgtggacaagtttctggaggcaaatccagcgtacaaaagccgcatatctgcttcggatttcgactttgcaccgcccgaggttgttgaggagactgttgtttctcacaattttctgcctctgcaaggttgccaaggccaagaaacaggagaaggcagagaggcacacaaaataggtgaaagcagagaggcatcgatgctctgaactgtgcctgtgccctgtgctatgtaggtgatagtccgctcaagatcacgtcacgtctcgttcctatctagtacggttgtctatctcggctgaagttaatgtagtaggtcttcttgcgtgttaattcctagggaatatatgagatgtttaataattagttgcttaggccttaaaactgtgcttccttaacttttgttcttcagtcatctcgtatatgcacgttgttcccgttagctagcagcctagtcggtgactgtgcatctcgttatcatagctagatgtctgtgcgcataaagcttgagcaaaatctaacatttcatacagtgtagcacaagacaagaaacaaatgtgtaggaccaacaatgtatgtagactagcaacgttgacctgatgctggcatgccagagagttctttcgatgatgttgatggggcac

SEQ ID NO: 850 - DNA, 700 bp, Zea mays
  misc_feature (111)..(111): n is a, c, g, or t
  misc_feature (136)..(136): n is a, c, g, or t
  misc_feature (166)..(166): n is a, c, g, or t
  misc_feature (202)..(202): n is a, c, g, or t
  misc_feature (411)..(412): n is a, c, g, or t
  misc_feature (445)..(445): n is a, c, g, or t
  misc_feature (464)..(464): n is a, c, g, or t
  misc_feature (535)..(535): n is a, c, g, or t
  misc_feature (546)..(546): n is a, c, g, or t
  misc_feature (597)..(597): n is a, c, g, or t
  misc_feature (600)..(600): n is a, c, g, or t
  unsure (1)..(700): unsure at all n locations
cctccagtatcaggtcatgcagggtcccggtcaccacctgccgcttggatttgagcaccctagtaaactccaaagcggcgccctgtacaagaaaattctccaaatattatnaactcggaagaaactcagcgtggcngtgggggtacatacatctacggagagatgngagatcatgccactaatatgagaaaatacaagttcnaccattaaccgaaacgttgattctagcaaatctagtaggtcactcccccaaagagttgagacctaagtttaaggacccctgcaagttgatgcaactggaaagcccgttagcgaatccatggacccaactcttttcccctctcgggagtgaaacttcattgacctaattaggtggcgtcacctcgtaagtcaatgcaattcactctctcnnatggtagtacataccaagagtccacacgctganggaattggtatcggcaggntggagagacgaggagggaggcgcacacctggttcttgttgtagtgggcgacggcgaagcgagcggcgtccncggcctcggcncgctcgcggagcgcggcgagcacacccctcacgagaccgctctcgtccccnccnaggtgaaacccggagaccgcggcggcggaggccgcgaggagcaccgcggcgaagagaagggcgcggcgaggcatcatcgtcagcgcggcgaacctactac

SEQ ID NO: 851 - DNA, 615 bp, Zea mays
aaatctctgtttgctgcgacttgttcttcttgtgtgtgagagtgggacgaaatctcgtgtgtttgtatgtggcagtttggctcgcttgtttgaatgtaagccatgtgcgcgtggtcatttctactgcaataggagtagagtacttacgatccaacaccgaccgataactactgctatagctcaatagctgtacagtagattacgaagctttgatccgaattaactgcgccggttaatgcgcgtgtcagcatgcacggtggtgctcattgctcgctcgggaaagaagcatttattaaagcggcagagcgactgatggagcgtgtcaatatacataccgatttcctcctcccatgctgttctgttgagaattgatggctgctcgtgtttgccctagccctgcctgatgaatccggataccggctgggtggcccctgtcctgctgcccgattgcagttgcagttgcaagcaacaccgatcaatttatctcgtggttgatgacgattgacgacgcatggtacaaacacgtgaaatgggggacgtatagtagtaactgcgagcgccgttcagatagattatgggcaatatccaccctgctatgctacccaccgcaaacta

SEQ ID NO: 852 - DNA, 612 bp, Zea mays
  misc_feature (108)..(109): n is a, c, g, or t
  misc_feature (331)..(331): n is a, c, g, or t
  misc_feature (404)..(404): n is a, c, g, or t
  misc_feature (461)..(461): n is a, c, g, or t
  misc_feature (467)..(467): n is a, c, g, or t
  misc_feature (507)..(509): n is a, c, g, or t
  misc_feature (518)..(522): n is a, c, g, or t
  misc_feature (527)..(528): n is a, c, g, or t
  misc_feature (531)..(532): n is a, c, g, or t
  misc_feature (536)..(539): n is a, c, g, or t
  misc_feature (543)..(545): n is a, c, g, or t
  misc_feature (549)..(555): n is a, c, g, or t
  misc_feature (557)..(559): n is a, c, g, or t
  misc_feature (565)..(567): n is a, c, g, or t
  misc_feature (569)..(570): n is a, c, g, or t
  misc_feature (573)..(576): n is a, c, g, or t
  misc_feature (578)..(578): n is a, c, g, or t
  misc_feature (580)..(611): n is a, c, g, or t
  unsure (1)..(612): unsure at all n locations
tgcctgcagttctgagttcactttgttcgttttccaattaagtaggatatacaacctttttgctattttgcttggagtaggctctgtgtgtgatttacaaaaaaaaanngattcgctgtgtattcaaaatgggttagctacttaacgtagttcatgatttcgggttgggatgcctcataaatcaatccatctcaatggtggtggcagaggtgcttgtcttagatgggtcatgatcaaactagagtttgggtgtcttggcacatatgagcgtgatgtttggcatgtgcatttattcaagcatgatattatggataggttcaattgaaaattncgaaagggtctctagttgagttggttaggtggcttgagtagcactcctcacgttctttgtttgacctctcacnggagcgaatttcaggttgggtttagaaaaatcccataccctgttccatggcaaagcncatgtntaaggttcgatcgggttgttctcacatgggctacggtgcnnntgtgtatgnnnnntacannggnnatcnnnntctnnntgannnnnnntnnntaacgnnntnnctnnnngntnnnnnnnnnnnnnnnnnnnnnnnnnnnnnnnnt

SEQ ID NO: 853 - DNA, 722 bp, Zea mays
  misc_feature (184)..(184): n is a, c, g, or t
  misc_feature (247)..(252): n is a, c, g, or t
  misc_feature (429)..(429): n is a, c, g, or t
  misc_feature (488)..(488): n is a, c, g, or t
  misc_feature (495)..(495): n is a, c, g, or t
  misc_feature (497)..(497): n is a, c, g, or t
  misc_feature (579)..(579): n is a, c, g, or t
  misc_feature (603)..(607): n is a, c, g, or t
  misc_feature (612)..(613): n is a, c, g, or t
  misc_feature (622)..(623): n is a, c, g, or t
  misc_feature (628)..(629): n is a, c, g, or t
  misc_feature (639)..(643): n is a, c, g, or t
  misc_feature (653)..(663): n is a, c, g, or t
  misc_feature (668)..(671): n is a, c, g, or t
  misc_feature (673)..(675): n is a, c, g, or t
  misc_feature (685)..(707): n is a, c, g, or t
  misc_feature (710)..(721): n is a, c, g, or t
  unsure (1)..(722): unsure at all n locations
gagctcctactgaatctgaaacacttgttgaagattccacaaagcagacagcagctgcaaccacgtttgaacatggaacggaatgctacggttatcatgagaatgggagtttagttaatgaaatttctgcaccaacccatttttcacctgttggtgatttgcagcatataggcaaacaaatganaggaagtgttagtggcaaaatggatatattgaagcaagatgctaattccagccaagatgttcnnnnnnctatgatccatgagattatgatcactcctaacaaacgagcaattgagaaagactctcaggttggtcaggcttcaaaaacaatttcgaagactgtcaaggtgacttctagtaatgtttctgatcacacatacgtttccaaggtattcacacattgattttggacatcttcccatcttnttcattgttgcaatctgtatgtgcattcttttctaataagttgactatcgtcctggacntggctcngnacaagacaggaaataaatgcctcattatttttgtgaaacgtcataactagaattcataagctatgccctatctatttgaatnaccttgatgcatgccgagatggcnnnnntgatnncttcagttnnctgcnnctttagccannnnnatatattatnnnnnnnnnnntgtannnnannncctgtacacnnnnnnnnnnnnnnnnnnnnnnnttnnnnnnnnnnnnt

SEQ ID NO: 854 - DNA, 553 bp, Zea mays
  misc_feature (29)..(29): n is a, c, g, or t
  misc_feature (73)..(78): n is a, c, g, or t
  misc_feature (103)..(103): n is a, c, g, or t
  misc_feature (107)..(107): n is a, c, g, or t
  misc_feature (175)..(175): n is a, c, g, or t
  misc_feature (211)..(211): n is a, c, g, or t
  misc_feature (330)..(330): n is a, c, g, or t
  misc_feature (345)..(347): n is a, c, g, or t
  misc_feature (368)..(368): n is a, c, g, or t
  unsure (1)..(553): unsure at all n locations
tgaatgtgtcgagggcctgcaaaatttanttttggtaaagcttaggacagaagcaaaatgcatagatatccannnnnnaaatagcaaatgtttttatacgatntaancattaagtaaatccatttctcttgacacaactacaggttattgtatatgagcatagcgttgatcatanattcttaccttgtttagatagttcatctgtgttacnatgcacaagattacaacaaatgagaacacccatgtttgtgaataaacaagctggttcatccctgaaaatgtcaccttcaaggctatcccaagagctttgacactcatgacctggcaaancaaagacaatacagnnngagagtatttatgtcctagcnttcttgagaatagttatgtgaattcacatggaaagaactgttaatcatgagaagcataccgataaagatccaacaagagaacatatgccaatatataccatgatatgtgtctgcccatactgagggacaaaatggcatatgagcacaaaagctgctgcaaatacaacagctgcatagaataggaa

SEQ ID NO: 855 - DNA, 750 bp, Zea mays
  misc_feature (202)..(202): n is a, c, g, or t
  misc_feature (235)..(235): n is a, c, g, or t
  misc_feature (313)..(313): n is a, c, g, or t
  misc_feature (575)..(596): n is a, c, g, or t
  misc_feature (623)..(624): n is a, c, g, or t
  misc_feature (633)..(634): n is a, c, g, or t
  misc_feature (650)..(650): n is a, c, g, or t
  misc_feature (662)..(667): n is a, c, g, or t
  misc_feature (672)..(672): n is a, c, g, or t
  misc_feature (674)..(677): n is a, c, g, or t
  misc_feature (689)..(703): n is a, c, g, or t
  misc_feature (708)..(748): n is a, c, g, or t
  unsure (1)..(750): unsure at all n locations
tgtcacaaagctctctgttcacttgttcaatggagacacaagccaggcagctttccgcatattgtctgactacaggaaaggcaaatttggatgggtagcgctggagagacctccaacatgaacaagcgggatatcatagatccttagataaaagacatgtgcttgttcatgtagtatcacacaatttagtgtcgttcattgnaccactctcgacagttttcactggacctgcacntatacgaggaattaattcagaatagctgtccatctgatgatctaaagacaaaacttaagaaatgctcctgctgttatnagacagtccagagcaaacgagctgatttgtatgatctattgaatgagctcaactatgtttctatgtaacggaattaggtttgagaaatgaaagattgtatgtctcctaatttagttgctcatgtacttctttgttcttttaggaaaagttgctcctgtacttctggatgatccattagattcgggaactggtgtaacattttaggtccagacaatagacatccctctacagtttcagtttccctgcttttaagttttctgcnnnnnnnnnnnnnnnnnnnnnnctcccttctaaactataagtcgttttnncttttcttnntacatgatttttaccngtataatttttnnnnnntatcnannnntaaactaatatnnnnnnnnnnnnnnnagctnnnnnnnnnnnnnnnnnnnnnnnnnnnnnnnnnnnnnnnnnga

SEQ ID NO: 856 - DNA, 591 bp, Zea mays
  misc_feature (2)..(3): n is a, c, g, or t
  misc_feature (10)..(13): n is a, c, g, or t
  misc_feature (44)..(47): n is a, c, g, or t
  misc_feature (77)..(79): n is a, c, g, or t
  misc_feature (146)..(146): n is a, c, g, or t
  misc_feature (201)..(201): n is a, c, g, or t
  misc_feature (221)..(221): n is a, c, g, or t
  misc_feature (223)..(223): n is a, c, g, or t
  misc_feature (242)..(242): n is a, c, g, or t
  misc_feature (261)..(261): n is a, c, g, or t
  misc_feature (306)..(306): n is a, c, g, or t
  misc_feature (346)..(346): n is a, c, g, or t
  misc_feature (348)..(349): n is a, c, g, or t
  misc_feature (404)..(404): n is a, c, g, or t
  misc_feature (414)..(414): n is a, c, g, or t
  misc_feature (474)..(474): n is a, c, g, or t
  misc_feature (483)..(483): n is a, c, g, or t
  misc_feature (495)..(495): n is a, c, g, or t
  misc_feature (522)..(524): n is a, c, g, or t
  misc_feature (549)..(549): n is a, c, g, or t
  misc_feature (552)..(554): n is a, c, g, or t
  misc_feature (556)..(560): n is a, c, g, or t
  misc_feature (562)..(566): n is a, c, g, or t
  misc_feature (570)..(575): n is a, c, g, or t
  misc_feature (583)..(589): n is a, c, g, or t
  unsure (1)..(591): unsure at all n locations
cnngcgcctnnnnttctagaacaaggcgagtagcacgcctttannnncccggctcgccttactacctaagcgtctcnnnggcgacgcttgaatactatgtatatactttgtttcaatagttaacctggtagtttggattttttttnaaattctagctaacaatttgtttaatacatatgctgaactcttgttaaggtgccnttaaactggaaggattagananggcaaaagctagtggtgcntgccagcttgttgtgaagnatctgaaagaataatttgttggtgaatatacatacccctgcttgngtgctggtgcaattcatgaaagaaagtatttgctggggantnnaatggctaggcctgttattgctaaggtaaagttgctctggtaattacattttttnacatataatnaccaaaaatgcatcctattttcttaaaagtagatactacttattttcttgagatctaatngacattatngcttacagtatngtttagtagtgtgcacatgcgcatgtnnnaacacattattagtattataattanaannncnnnnnannnnntgannnnnntgatgtgnnnnnnnga

SEQ ID NO: 857 - DNA, 602 bp, Zea mays
  misc_feature (8)..(13): n is a, c, g, or t
  misc_feature (15)..(15): n is a, c, g, or t
  misc_feature (384)..(384): n is a, c, g, or t
  unsure (1)..(602): unsure at all n locations
aggatccnnnnnngnagcaatttcgaccagggaagctcattaacagaaaatgatgccacagccagtgaaattgaatgtcacagactccaaatggctgcaataaatgattatggatttggtaaacctgagattccttctagttcctcaatgccatttttcttggctgttgatcctcaacaactgaaattgagaaatgagacaaatgtttcttcaacatcttccaacattccttcagattctgcatcaccaaacttgaaaaatggcacggatcctcttttgatgccatttaattcctacatggcagattggagcagcgataagataacttacaccactctgaacactccaaaaataagcacagaacttccaggtcagtatgcatcnctttcttctattattagctaaatcaatttagctgacaacaaaaacttaaccatgcagtcaagttacaccatgacaaaagtagtagctttgaagcaccaaacctgaaggagcatgaatcagtctttgcaacacatgaaatgacggtagaagcaacaagaaaagaagacgaacacacatcaaaatctagttttacttcctacaatggagtaccagataca

SEQ ID NO: 858 - DNA, 704 bp, Zea mays
  misc_feature (3)..(7): n is a, c, g, or t
  misc_feature (60)..(62): n is a, c, g, or t
  misc_feature (138)..(138): n is a, c, g, or t
  misc_feature (154)..(154): n is a, c, g, or t
  misc_feature (222)..(222): n is a, c, g, or t
  misc_feature (444)..(444): n is a, c, g, or t
  misc_feature (453)..(453): n is a, c, g, or t
  misc_feature (495)..(495): n is a, c, g, or t
  misc_feature (562)..(564): n is a, c, g, or t
  misc_feature (608)..(608): n is a, c, g, or t
  misc_feature (658)..(658): n is a, c, g, or t
  misc_feature (662)..(663): n is a, c, g, or t
  misc_feature (666)..(666): n is a, c, g, or t
  misc_feature (671)..(678): n is a, c, g, or t
  misc_feature (682)..(685): n is a, c, g, or t
  misc_feature (687)..(688): n is a, c, g, or t
  misc_feature (690)..(703): n is a, c, g, or t
  unsure (1)..(704): unsure at all n locations
tgnnnnntctttggcaactgcttttatcaaaactacttcaggctgacctaccagttcatnnntagtaagttcagcactgcacggctgcacatctaaaaccacaagaacacacttagcgaaaacaggaacacaaaaggncgcagcctacatccangtctgtccaggtgtgatgatgcatctaaatactgcctccaccgaccggattacagctattactttcgntccatgcctaacggctcgcatcaacagttccaacactattatgacaaaccaagctcagctccacccctttttattcctgaaaaacaaaaggagaacaggatgtgaataaaatgatgtgaggccatggagaaagcatcgcaagtaacagcagaaacaggggtagcgcaatagggtgtgaacaaaatgatgaggccactgagaaagcattgcaagtgacagggngtggcgggntgctaggattcaaggaagtgtaggctgtcatgataagctatncaaaacatgatcaagtcctatgtgtcaccgttatccttaatgcctatgccttatatacctgctaccnnntttttctttaacaagtgacacttgccagcatcttaatcataagntaacacttgcaagagattgtaatactactacttgccatgaaattgagatntagnncanctaannnnnnnngatnnnnanntnnnnnnnnnnnnnnc

SEQ ID NO: 859 - DNA, 484 bp, Zea mays
  misc_feature (224)..(225): n is a, c, g, or t
  unsure (1)..(484): unsure at all n locations
cctgcctcgccacctacgccgtcgccgttcgcagggaccccgggcgggtgcccccgggtttcgtgcccgacgtcgaggacgccgagagcaccgtccacgagatcaagcgcaaggtgcgttggcgtggcgttgtctctctctcccttgctcgcctgcggttcgacgggcgggtttccgttcgctgttaggtgttagggttgttttggatctgcgggtgggagagnngggcctgctgcttcaaaatttactaccgttcgtttcaaacttgggggccttcctcaaagcttagaaaatgcgattctgatgcagcttggttagtatttttttggataattttggtacatatctttgattctaaatttgacaccgttcatttgaaacttaggaaacttattcaaagtcgagcaaatgcgattcagatgtacctttggttgataattttggaccattttgggtacatatagttctgctctagaattttcca

SEQ ID NO: 860 - DNA, 947 bp, Zea mays
  misc_feature (40)..(40): n is a, c, g, or t
  misc_feature (133)..(133): n is a, c, g, or t
  misc_feature (148)..(148): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (198)..(198): n is a, c, g, or t
  misc_feature (228)..(231): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (342)..(342): n is a, c, g, or t
  misc_feature (367)..(367): n is a, c, g, or t
  misc_feature (391)..(393): n is a, c, g, or t
  misc_feature (396)..(396): n is a, c, g, or t
  misc_feature (409)..(410): n is a, c, g, or t
  misc_feature (449)..(449): n is a, c, g, or t
  misc_feature (513)..(513): n is a, c, g, or t
  misc_feature (551)..(551): n is a, c, g, or t
  misc_feature (772)..(772): n is a, c, g, or t
  unsure (1)..(947): unsure at all n locations
agcaacacaatgtgccccctatgcatccaccgggagcacntgccctagatggcgatatcaaaacaagtataatgacaacaatacactagacttcttgttgatgtctaaggtcgctgtatacaaaggttgcaanctgatgtacaaaggnatgagctaacatgtgggcaccatgagaaaatctgaaacaatncgntantnttgacagtgaaagaacatgtaaccagatannnngtaatgaatcaacaccaattatatttcacaatttgtgactaaagaaaaaaanantnctagcattaattattctcatcttccaaaacataactctggacttatcactagcantggccattgtgcacttatcattagncaaaaaaaaaagtgcatgcacaannnganaaaaaaaacttcnnatacaacaaagaatttagccattatcagattcaccttancatcatagcatagtagtttcaaaatggcaaatatgtagtactactgctccacacccgaattcantagctgactacatataccaaagctgaaatacttcaaanatagcaaacaagatcagaagacatggcattcatgtacttacggatgcaagaagtgctcaaacagccatgagcgaagaacagacactgcacgctcaggaagccctctttgaggcctccaaatgttgtgaggctggctgaacgcgttcacgctgtttcccctcaggaggcctgctccaccacccatgagcgcgaagttcgccatatcgtccttggcaataatnccatggttggcgatgaccttgctcgtgttccgtagctggctcatcaccatccccttcagacacttgaagtgcttcgacatcgtccgaagagccatgaaagcgaagggggccgcgttgctcagccctgcaacagtctcgaacgaggagatcacggattgcagctgctggtagtact

SEQ ID NO: 861 - DNA, 770 bp, Zea mays
  misc_feature (3)..(3): n is a, c, g, or t
  misc_feature (54)..(54): n is a, c, g, or t
  misc_feature (113)..(113): n is a, c, g, or t
  misc_feature (115)..(115): n is a, c, g, or t
  misc_feature (285)..(285): n is a, c, g, or t
  misc_feature (461)..(461): n is a, c, g, or t
  misc_feature (503)..(503): n is a, c, g, or t
  misc_feature (736)..(737): n is a, c, g, or t
  misc_feature (768)..(768): n is a, c, g, or t
  unsure (1)..(770): unsure at all n locations
gcngataagtttcaggaataaaggggtattatgcttctagaataaatttaagangatatagctgaagagatgctccaaacatcactaatgtatttttaatataggatatcctncntcgactatatatcaatatcatagcaagtccaataaaaaggttgtagtagtcacaaatatatcatatttgtttttacagatttccatgttaagtttaatatcaaattcatatccaacatactacaagtgctctctattctacagtaaatgatagtaatcagatacagaggntctgttaccaattaataaagctataacatttggattagtaatcatatggaatgtaagcaacggatggctgaatataacatgaactcatataatacttggccaatgggggaagaccgcccccacagtctttactccgagaaacaatgtaagtcaaaccaacccataaaacttctganccccgcttcaccctatggagctgcattgtaacctggctctgnctcagacccaactcgatgggctgccaaccactgcaactacccaaaaaccaaccacaggtgccacaatcccaaatcctcctactgtttttaaggttgccatcgaaggaattgttttttggtgccatatactagaagaattcaagtacaataacaacaaagccttttacggggtgtttggcatggctccgctttaacccagagcaactctgctctaaaactccaggatggagcanntctgaagtttttttggatttcggagcagcanat

SEQ ID NO: 862 - DNA, 901 bp, Zea mays
tgatgaagcaccctccaatccatgaccagacaccttttcagctatctctcttccttctgtttcaagtacaatcctgtgtaatcattcaagaaaattaggtataatgccacaaataattacatactaatgtgggacgttattcatctctaagcttgagaatgatcctattgctaaacctttgaatccagtgattaaaaccattacaaaatagacgctcggatattactctattgccatggcccccagttcaaaaaaaaaacatgcggcagatgacagtcagattatttcagagcaaaggaagaataataaatgtacacaataaagggaacaagaaaagaagccctaatatcatgtatgtagtaagataaggatttaccctccatcaacaatttcatcaaggcacaataggatcatatccaaattctcgagtgctgtccttttgtcaaccatgtttctgaaaccaccaagattggaaacacattcatatacaatcagcattaacacaacaacatgtaacagaacaaaacagtggttgcaaagataaagtttaatagagggaaaataacttgagaagtcgttcgacagcatcagagaatccctgaagaactgatgctaaaataagctcattctcttcttctcctccagtaacaaaaaagtgcaggtcttggatgaacttgtataccacaatttgaccgtcaaacattacaatctcaactgttaaagagaaacaaagaaaaatatgaaatacttgaagagaagaacaaaaactcaaacagtcatatctgcatgtttaaggagaaatcaaggtcagtcagaaggaaaactagcccaggctcatttacagatttgtggcatgagtgggagctcgtacaaacagtgttatgactgaggttagtagagc

SEQ ID NO: 863 - DNA, 561 bp, Zea mays
  misc_feature (140)..(144): n is a, c, g, or t
  misc_feature (147)..(148): n is a, c, g, or t
  misc_feature (253)..(253): n is a, c, g, or t
  misc_feature (274)..(274): n is a, c, g, or t
  misc_feature (335)..(335): n is a, c, g, or t
  misc_feature (437)..(438): n is a, c, g, or t
  misc_feature (462)..(462): n is a, c, g, or t
  unsure (1)..(561): unsure at all n locations
acagaaaattaagttatagatatactgacagttataccgtacaaagaaggatcttttctattaagtcaacataaaattcaaaaatattactaaatgtcaacataaaattcaaaaatattactaaatgtcaacataaaatnnnnnatnntaaaattcattactattagaagtataacaaatggtgcaaggatagtgtcaatttaaactaggcaaagtatataattgatcagatagtagaaattcaagacgtgtntacatatgcagatcagacaanattcggatagtataccacagtatgtacagtcaatatgcgctagtctctacacaaactcaantggcagaatcaatatgcagaactttgattgatgtgcattaatgaaaaaatcatttggctaacaattaatcataattatgcaacaaattagcagaggcaatgnnttaaccatgccaaagcatttgaangacaagctaccaagcaatatttttgttttatcacaataaagttccacatttacaaacctcatcttcctgaggacgcccgccatctcctctctcttcttc

SEQ ID NO: 864 - DNA, 690 bp, Zea mays
  misc_feature (129)..(129): n is a, c, g, or t
  misc_feature (456)..(457): n is a, c, g, or t
  misc_feature (483)..(483): n is a, c, g, or t
  misc_feature (533)..(533): n is a, c, g, or t
  misc_feature (568)..(568): n is a, c, g, or t
  misc_feature (606)..(607): n is a, c, g, or t
  misc_feature (613)..(615): n is a, c, g, or t
  misc_feature (619)..(619): n is a, c, g, or t
  misc_feature (624)..(625): n is a, c, g, or t
  misc_feature (636)..(636): n is a, c, g, or t
  misc_feature (647)..(647): n is a, c, g, or t
  misc_feature (649)..(649): n is a, c, g, or t
  misc_feature (665)..(669): n is a, c, g, or t
  misc_feature (676)..(677): n is a, c, g, or t
  misc_feature (682)..(685): n is a, c, g, or t
  unsure (1)..(690): unsure at all n locations
tgcagcctcaagcaggagagaatgatagcgtacaacaccagcctggccaagtgctcctctacggcctcgtgttccagtgaccagagcctgaaccctgcaaactgcggctgcgcatacccctacgccggnaagatggtattcagagcgccgctcttcacggacctgacgaacagcgccacctttcagcagctggaggcgagcttcacgacgcagttgtctctccgcgatggctccgtgttcctctccgacatccacttcaatagcgacaactacctccagattcaggtggcgcttttcccgtcgtctggggtgtccttcagcgtggcggatctgatacggataggcttcgatctgagcaaccagacttacaaaccaccgtcgaattttggaccctattacttcattgcagatccatacgctcttttggcaggtactttagttccaccctcaaaaaanncaatctgtattcaagcagtatgatgntttttttttggagaactagtatatggcgtggtatggaaattcactgtgantttctgtgtcaggtgcttcttctcgtggcagtaanaaatcacatatcagcactggcgctatcgctggaattgnngtagcnnntggnattcnngtgattgcccncattggcatgntnttatttgcgttgcgannnnnaagaagnntcaannnngtgac

SEQ ID NO: 865 - DNA, 543 bp, Zea mays
  misc_feature (318)..(318): n is a, c, g, or t
  misc_feature (522)..(522): n is a, c, g, or t
  misc_feature (540)..(540): n is a, c, g, or t
  unsure (1)..(543): unsure at all n locations
aaagacggaacaaggaacgtgcttagcaccagggtcggagagaagcgacagcgtctgcttgcgaagcggggggggagcgcgggacccgggttacctgagcgctcgaactggagcttcttcttgggcttctccgccgtcttcctcacggcctggtgcttggttcgagccatcgcggtgggcgcctcgcactgctctcgtggccgacggtttcgattcagaactctcgggacgggagggcgtgtcgacggtgagtctttttttttaagggggcaggagatggtgaaatgaaaagaggtgcagcgttattatggtgagcantgagcactgagcacactggtgtggtgtctgcgtgcgagtggccgagtgcctatcgatgtaacggctacctgccaacctggcgtgccgaacgtttgagtagtgggcccggaatgcagtgagagatgctttctttatcatcgtcctcccagccggtaaccagcattgagttaaaaaaattctttacatcttggatgtaaaaaatancttttacagcttctcacntac

SEQ ID NO: 866 - DNA, 757 bp, Zea mays
  misc_feature (554)..(554): n is a, c, g, or t
  misc_feature (561)..(561): n is a, c, g, or t
  misc_feature (586)..(586): n is a, c, g, or t
  misc_feature (669)..(673): n is a, c, g, or t
  misc_feature (681)..(681): n is a, c, g, or t
  misc_feature (699)..(699): n is a, c, g, or t
  misc_feature (701)..(701): n is a, c, g, or t
  misc_feature (705)..(706): n is a, c, g, or t
  misc_feature (714)..(756): n is a, c, g, or t
  unsure (1)..(757): unsure at all n locations
accctgcaacagaaggctgcaaaaacttggtaactccctcggtcgatgcatgcgccctgtgggctgttccaaatgcatcgttaacataaagatctgctagggaggcaagcttctgtgcaaactctgggtcattcttctcctcttccttgtagaatcttacgttctcaagcagcagaaccccaccgttgggcaaggccgccaccagcttctcaacttcagggccaataacatcgtcggctttttgcacctatttgtatgtatagatacgctttagtcagaacaatcaattagcacatgtgatttcattacaagtaccaatgatgtagaataaatcaatacctgaatgccaagaagctcagacaaccgtcctacaaggggagctaagctaaacttgggtgtaaaacccttagggcgaccctgcacatccagagcaaaagggaggatattaatcatgactggatgaaaagattattaagcagcaatctgagataaatatattggttcagcaaatctttcataaaattatcattgaacccaataagaaaatctgcaantaatagncaatctgtatatacaaaaccagaantttaaataaacaatatcctatgcaggtccttggctgctacattgtgacttgtgagtgtatgcaaagagcaacagttacagagnnnnnttttctanattggagtcacaaacagntnctgnnttaaaagnnnnnnnnnnnnnnnnnnnnnnnnnnnnnnnnnnnnnnnnnnna

SEQ ID NO: 867 - DNA, 619 bp, Zea mays
aaaagttaggtggttcctgtttgggatgtggttagccatgtggccttttttgtttgagaagattaacaagaccaggtttgttttctctggtgaaagtgtgccagcaaaagagcgtgttctgttatttgctaaccacaggaccgaggttgactggatgtacttatgggattttgcattgaggaaaggccgcttgcagtgcatcaagtatatccttaagaaaagtttgatgaagttacctgttttcaactgggcatttcacattattgagtttattccggtagagagaaagtgggagattgatgaagcaataatccgaagcaggctttctgaatttaagaacccaaaggatcccctttggctggcagttttcccagaaggcactgattatacgtaagatctctttccattcttttcttcccacatgcttgcctagatcactgacatgatttggatttgcgctccaggcatctggaacaataatttgaatcattcacctccaatattttttctttttggcttctatgcttcaactgtccttttatctatctgtattctaactagtcctaatgttaatatctcagtgagaagaagtgtatcaaaagtcaagaatatgcacgaa

SEQ ID NO: 868 - DNA, 544 bp, Zea mays
  misc_feature (1)..(10): n is a, c, g, or t
  misc_feature (18)..(49): n is a, c, g, or t
  misc_feature (149)..(150): n is a, c, g, or t
  misc_feature (205)..(205): n is a, c, g, or t
  misc_feature (281)..(281): n is a, c, g, or t
  misc_feature (331)..(333): n is a, c, g, or t
  misc_feature (487)..(492): n is a, c, g, or t
  misc_feature (519)..(542): n is a, c, g, or t
  unsure (1)..(544): unsure at all n locations
nnnnnnnnnngctagccnnnnnnnnnnnnnnnnnnnnnnnnnnnnnnnnaacagaagctaccactgccggtgctcatcgtcctgcacctgaagcagcagcagcagctgatctgatcgacatacagttcgtgttcggcagctagcccctnnagccatgctcggagaggtttaatcaattacgcagcggactccttcgatgggggtngatttttggtgatcattctgggggtatgtataaacctgcaacctacccttgcaaggattagtttttcttcttctgnttttcttctttcaagtttcaccgaggtggagtggaggttgaccgacattnnnctgttcttcccgcatattcttgtgagattttgattccaatcagtgtctatcaattcaatttcgatctccctctctgtaaccacatgtcgtgtggcgtgcgtgcgtgtaaaaaatcgagaaaaccgagcctgccctgtccgggcttcagcttgtnnnnnntagctagctcgatctagcggaaacgannnnnnnnnnnnnnnnnnnnnnnntt

SEQ ID NO: 869 - DNA, 618 bp, Zea mays
  misc_feature (9)..(12): n is a, c, g, or t
  misc_feature (31)..(31): n is a, c, g, or t
  misc_feature (270)..(270): n is a, c, g, or t
  misc_feature (399)..(399): n is a, c, g, or t
  misc_feature (431)..(431): n is a, c, g, or t
  misc_feature (495)..(495): n is a, c, g, or t
  misc_feature (503)..(505): n is a, c, g, or t
  misc_feature (513)..(513): n is a, c, g, or t
  misc_feature (561)..(591): n is a, c, g, or t
  misc_feature (593)..(617): n is a, c, g, or t
  unsure (1)..(618): unsure at all n locations
atgcctgcnnnntatacaacaattttgtcanacagacatgaaaactgagctgaagttctgaacatcttcatcgacacagaaacactgtctggattagaatagagatcgaattaggttcgtcgagtacaaactcttgcagcttcagtaaaccagattaacaagatcaaaattttgtctttgaagtttatcagcatccaaatagggttatttgagataaaaaaatacaaatgcttcagggatggttcagtgaagtataccttatctgtttcngagccaccatcagtacctccatgcgtttctgaccaaaccgaccttcctttcagatcatattcaatccttattgagtcaatagctgcaccatggccaatcacgatctggcgtattgttgagtacacgccntcatcccaagggtaccctcctgtccctccccnaggtccaaccactatggggctctttccattaatgcttttgatgctctagtggacataaatcacnattttttnnntaggccanggtaatagaactagaattctaaaaactatatgatatatcacaaaaacnnnnnnnnnnnnnnnnnnnnnnnnnnnnnnnannnnnnnnnnnnnnnnnnnnnnnnnc

SEQ ID NO: 870 - DNA, 722 bp, Zea mays
  misc_feature (12)..(76): n is a, c, g, or t
  misc_feature (151)..(179): n is a, c, g, or t
  misc_feature (279)..(281): n is a, c, g, or t
  misc_feature (306)..(306): n is a, c, g, or t
  misc_feature (325)..(325): n is a, c, g, or t
  misc_feature (351)..(351): n is a, c, g, or t
  misc_feature (360)..(361): n is a, c, g, or t
  misc_feature (394)..(394): n is a, c, g, or t
  misc_feature (447)..(447): n is a, c, g, or t
  misc_feature (511)..(515): n is a, c, g, or t
  misc_feature (517)..(518): n is a, c, g, or t
  misc_feature (555)..(560): n is a, c, g, or t
  misc_feature (597)..(597): n is a, c, g, or t
  misc_feature (602)..(604): n is a, c, g, or t
  misc_feature (647)..(649): n is a, c, g, or t
  misc_feature (673)..(674): n is a, c, g, or t
  misc_feature (684)..(684): n is a, c, g, or t
  misc_feature (691)..(692): n is a, c, g, or t
  misc_feature (695)..(697): n is a, c, g, or t
  misc_feature (702)..(709): n is a, c, g, or t
  misc_feature (713)..(721): n is a, c, g, or t
  unsure (1)..(722): unsure at all n locations
gggtcgtcggannnnnnnnnnnnnnnnnnnnnnnnnnnnnnnnnnnnnnnnnnnnnnnnnnnnnnnnnnnnnnnnnatgatggaccggttcctgccggccgcgcacgccgtggccgccgccgggtccccgcagaacgccttccgccgcaannnnnnnnnnnnnnnnnnnnnnnnnnnnnacaggaggttgtacttgttgccagcgcagccgcagaggcgggtgcccctccaccacattgcggcgtgccacctgccgccgcccgtccctcccgctcccannngcagcccccgtggcaagaacgacgnctacgacggcgccagttcngacgcgcgcagcacgccgggcttcgngtccaggannaggaggtgcggcctgctctccgtccggtgcgtnaggagcgccttgcggcgacgtgcgggcagaccgttccggtccaacggcggcgncagaagccgaagagaaaagaagccactgctgccgcataccggagacgatcacggcatggtactnnnnntnnctgttgtacatatatatatcctcgtgcatgtgcatgnnnnnncatgaacttcactcgcatgctaaattaacgaaatcantactnnntcatgcggaacaaacaactcccgtcttctctcgcgcataaatnnntctctcgcagcaatgctgggaggnngtgtacatcnagtcgcnnctnnngtcannnnnnnncagnnnnnnnnna

SEQ ID NO: 871 - DNA, 1249 bp, Zea mays
  misc_feature (4)..(7): n is a, c, g, or t
  misc_feature (411)..(417): n is a, c, g, or t
  misc_feature (432)..(432): n is a, c, g, or t
  misc_feature (440)..(440): n is a, c, g, or t
  misc_feature (461)..(466): n is a, c, g, or t
  misc_feature (474)..(478): n is a, c, g, or t
  misc_feature (500)..(504): n is a, c, g, or t
  misc_feature (506)..(514): n is a, c, g, or t
  misc_feature (517)..(524): n is a, c, g, or t
  misc_feature (541)..(542): n is a, c, g, or t
  misc_feature (548)..(644): n is a, c, g, or t
  misc_feature (646)..(701): n is a, c, g, or t
  misc_feature (703)..(743): n is a, c, g, or t
  misc_feature (746)..(746): n is a, c, g, or t
  misc_feature (749)..(754): n is a, c, g, or t
  misc_feature (756)..(756): n is a, c, g, or t
  misc_feature (760)..(763): n is a, c, g, or t
  misc_feature (765)..(769): n is a, c, g, or t
  misc_feature (772)..(774): n is a, c, g, or t
  misc_feature (776)..(780): n is a, c, g, or t
  misc_feature (782)..(782): n is a, c, g, or t
  misc_feature (784)..(790): n is a, c, g, or t
  misc_feature (792)..(797): n is a, c, g, or t
  misc_feature (818)..(819): n is a, c, g, or t
  misc_feature (821)..(822): n is a, c, g, or t
  misc_feature (826)..(828): n is a, c, g, or t
  misc_feature (832)..(835): n is a, c, g, or t
  unsure (1)..(1249): unsure at all n locations
ttcnnnnatcttcctctattgatactgtaggttcaattgcttcagcagttggcattgttttagacaatttttgtttgattctgcattgacaacaaaggttttcccaaatggtttcccacttaggttgaaaatgatgatttgattgcctacggcctgatcccagaatttattggaaggttgccaataacagttggcctgaccaatcttagtgaagagcaattggttcaagtagtaaatttctttgattttataatttaaagcaatatttcttaaaattaccatctcaaatatttccaccacctcaaaatattagaaattctctttgcaggtgctcatggagcccaaaaacgcaataggaaagcaatacaagaagctattcaaaatgaatgatgttagtttgtgattcgtttnnnnnnncgaaataattgcaanatttggcngatttttttttactttaaacnnnnnnttataacnnnnnaagttatttatgttcatgtttnnnnnannnnnnnnngcnnnnnnnnactgataatgctttgannatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnggntannnnnntncttnnnnannnnnagnnngnnnnncnannnnnnncnnnnnngtgtcgagcaaaaatttttcnngnngatnnngccnnnnaactgtatgtttaccagaacaatatcaaactgcccgggctgattcagagcaaccccagacgcagacgcattttccggctctgccttctagtcgcattatcggcaacaaagctttggatttaccagacaattccttgtttttcatcgatatatgaatggattgcatggatactatgcaaggtctacaattttacacaataaaatatgatgaggttgattttcgtgttaaactgttcacacagcaaaagaatggctggaccccacgttctgctttcttcggtagcttgcaatgattttgcaacaacaattcgtatcatttacacgctactggtagcaaacagacagttgttttgatactgaacctgaacaaatggaaaatggtttccaatggttacacatcaaaattatgtttgta

SEQ ID NO: 872 - DNA, 1019 bp, Zea mays
  misc_feature (291)..(291): n is a, c, g, or t
  misc_feature (341)..(341): n is a, c, g, or t
  misc_feature (373)..(373): n is a, c, g, or t
  misc_feature (436)..(436): n is a, c, g, or t
  unsure (1)..(1019): unsure at all n locations
caatgtcgaacgacgattcagaacgttatcgcaatgcatacctcctgcatgaccagatcgcgagcgaccttcatggagttcttgcccaccatcccagcgaggaggtgctcggcgccgaggttcgatgtcatgatgatcacggtgttcctgaagtccaccgtcctgccttgcccatccgtcagcctgccgtcgtcgaggacctggagcagggtgttgaacacggcgacatgggccttctcgacctcgtcgaacaggatcacgctgtacggcctcctcctcacttgttcagtnagctgcccaccctcttcatggccgacgtagcttcagtcacaggtccggcncatgtcagaacaagagttcatcgcaattcgcngttaaaaatacgaagatgcatgcattttctgctacttacccaggtggtgctccgatgaggcgngcaaccgagtgctgctccatgtactccgacatgtcgatgcggacaagaaggttctcgtcgtcgaacagctgttcggctagggccttggccagctcagttttccccacgccagtcggacccaggaagaggaacgagccagtgggctgttgtggcctgccaagaccggccctcgacctcagcaccgcctctgcgacggcgctcacagcctctgtctggccgaccaccctctggtgaagcctgtcagccaggccgaccagcctctccttgtcgttctggccaagccgggtcactggaatacccgtccaacggctcaccacctgcccatagaacgaaacaccatttcagcacgctgcacgactacgctactaggagacgatcggcaattcggcattgctctgcaaattttttgtggcggtgaacaagaacaataacatacctctgcaatttgttcagggccgacggtttcggtgagcatcaggttctcccctgtttcgctctccagcttggagatcgcggcgtcgatttcctggagggcgccgtacttgagatcggccacacgggccaggtccatccggcgctcggc

SEQ ID NO: 873 - DNA, 468 bp, Zea mays
aattatttgatgatagccctacttctgtatggttccttcttacatagtttttcccctttgtataataatcattgttcagatccaatcacttgttgacaaaatctcttatgaaactaaagtcaggtgacagtagcccagagagttctacaaattcaacaaaaaatgaaaataggaatgaaaaacacgaaacagctccaaaggaaaaaacatcaaagaagaaccggaagaaggagaaagaagtggcagagagtgttcctgtaaagcctaaaaaggaaaataggcctttggttctgccttttgaattatctgttatgggtattttattgctcatcgtattaggtggtttctatgtggtaagttctctgttgttagtcttaccagaatgaagacaatgaatgtcttcattgaatgaggtaatcttaatgttaatgattccatttttttaggtccattgtgtatgggcggcag

SEQ ID NO: 874 - DNA, 664 bp, Zea mays
  misc_feature (59)..(59): n is a, c, g, or t
  misc_feature (220)..(220): n is a, c, g, or t
  misc_feature (566)..(568): n is a, c, g, or t
  misc_feature (593)..(601): n is a, c, g, or t
  misc_feature (606)..(617): n is a, c, g, or t
  misc_feature (624)..(628): n is a, c, g, or t
  misc_feature (631)..(636): n is a, c, g, or t
  misc_feature (638)..(638): n is a, c, g, or t
  misc_feature (641)..(644): n is a, c, g, or t
  misc_feature (657)..(661): n is a, c, g, or t
  misc_feature (663)..(663): n is a, c, g, or t
  unsure (1)..(664): unsure at all n locations
cgggtacggcaacgttgtgcagacgctcgaggaggcgcggaagatcgtcgccacgcggncggcggcgggcacccaggcccaggccgacgacatgaacacgaagctgtcggccgccgtcacgagcgccagcgactgcgacaacgccttcgccgacttcccggcgattaggtccccattcttgcccatgcagcggaacgtctaccgcctcgtcgacaacgtnctcaacatcttcgtcgtcgtcaaccagccggagcacgcgcacaagcacgggcactagccgcgtgcgcgctggccggcctgccagttgtaagagccgggatggtgttgtatcgatctcctttctgcacttgaatatatatgtgaacaaggcttgagaaaaatctgtattgctagttgtagtgtaacttgatcaggttactgctaacacggaatttcaggtttagcttcttgttcttggtttcaaaaaaaaaatgtgtctcgccaaaagtacgacttcactttttggcagccggatgttagctgttgaaaattaactcatttttaattgctggtaacatacacctaannnactgtttgggaacaaagtttttctnnnnnnnnnatatnnnnnnnnnnnnttgatannnnntcnnnnnncnatnnnnactactacgtacnnnnnant

SEQ ID NO: 875 - DNA, 705 bp, Zea mays
  misc_feature (88)..(89): n is a, c, g, or t
  misc_feature (91)..(91): n is a, c, g, or t
  misc_feature (164)..(164): n is a, c, g, or t
  misc_feature (169)..(169): n is a, c, g, or t
  misc_feature (183)..(183): n is a, c, g, or t
  misc_feature (328)..(328): n is a, c, g, or t
  misc_feature (342)..(347): n is a, c, g, or t
  misc_feature (437)..(438): n is a, c, g, or t
  misc_feature (520)..(520): n is a, c, g, or t
  misc_feature (522)..(522): n is a, c, g, or t
  misc_feature (546)..(642): n is a, c, g, or t
  misc_feature (648)..(654): n is a, c, g, or t
  misc_feature (656)..(656): n is a, c, g, or t
  misc_feature (658)..(704): n is a, c, g, or t
  unsure (1)..(705): unsure at all n locations
aggaacataaacgccaaacatgactagtacagctgacagcactaatctagagagagagagagagattccagactttcttttacttttnncntcacaataaatgctagaacaacaacagaagccagcatgtaaacacataagaatttgatctcagctctttctcncacanaaaaaaagaaatanaatgaaagcagaaggcaaaggataattacacgagtaataccagtcagactgagccatgtatgcatgcatggccactggggtgcaccatgccaccatcacatcaccttcactttgagttgacccacaccaacacaagcccatgagntatactcatacacnnnnnnccatgcatcagtccgtgacacacatattataccaactaataaccagtccataaaaaaatcatggactatatataaaaagccacatatttnnatttaataaaatatagtaaaaagaaacatatggccatatattttttaatattgcttccatcacaaaacaaatacacttctantnttttaataaagatattaatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggnnnnnnntnannnnnnnnnnnnnnnnnnnnnnnnnnnnnnnnnnnnnnnnnnnnnnna

SEQ ID NO: 876 - DNA, 741 bp, Zea mays
  misc_feature (166)..(166): n is a, c, g, or t
  misc_feature (481)..(481): n is a, c, g, or t
  misc_feature (547)..(547): n is a, c, g, or t
  misc_feature (588)..(589): n is a, c, g, or t
  misc_feature (597)..(597): n is a, c, g, or t
  misc_feature (668)..(668): n is a, c, g, or t
  misc_feature (672)..(672): n is a, c, g, or t
  misc_feature (675)..(675): n is a, c, g, or t
  misc_feature (677)..(681): n is a, c, g, or t
  misc_feature (691)..(693): n is a, c, g, or t
  misc_feature (695)..(699): n is a, c, g, or t
  misc_feature (707)..(707): n is a, c, g, or t
  misc_feature (709)..(709): n is a, c, g, or t
  misc_feature (720)..(722): n is a, c, g, or t
  misc_feature (726)..(727): n is a, c, g, or t
  misc_feature (729)..(739): n is a, c, g, or t
  unsure (1)..(741): unsure at all n locations
atgacagtgtgcttaatctttagtgttaggccgtgcgcttatatgtactgtagagtctactgtttatagagtgaattttgaaatggggagtgggataggaaggctgctggaaacagccttaatgcatataagaatacattttggattagatgtttttgctgtggcnaagatttgtttgttctatcaattttgcatttgttttgcagctcttgttatcctatctgtctagcctctactctattgtctctactgagcattatatcatgatattaatgcataactttatacaatcattgaattttgtatatattcgtgtattatactacacatcttgtgagtttataacctcatccagtctattgtttgttatcatcattattgtttgtcatcagcattgttgtttgctatcagcattatatctcacctagtgtgtcagtgctcttggtattacgtctagatagtgtttgcttgggcacatgtngtcttgaactctgctgatgtaattttgttcctacagttgcctttttgccatcagcagtgattattntcaattgtgcatctcaactatagtctgcaatgaattttctnntacttgtnaagttgtcatataatgtgtcatggcctactatcatttagacatgtacacacattttatttactcatgaatncagntantnnnnntttattttcnnncnnnnngtctttcntncttatatttannnatgnnannnnnnnnnnnct

SEQ ID NO: 877 - DNA, 756 bp, Zea mays
cattaataatatttgaattgtgatgctttccctttctagtcatgtgtggttgatacttgttctttttgtactagcacacatagttatattctgtcatagtatcagggtttgccacgtgctaactccctttcccttcagttagttgatcacattttattggtaaacacaggggaagctgtacacgatcatggaaatatgccgtatgtttgatggtatttacaaagagcatctggatggagtgtatgttccaaacaatatttccacagtcactttttcagagttttatttgacatgacttgataacatttttaggttctgtaaaaaaatcctcaaatcctagtaacatttatcgtctcctgttatgatgtttgatgcagagttatatattgtaatgcatgtagacagtctgctgaagattttgtttagtcagttttgtcacagtttaactagtaccatgaaagtttgatgaagctaggaatctagagcaaggggagagacgacccctaaatttaatcttctggtgcaaaattgaatgccattcaggggctcgtatgtttttcttgcttgttgtcgaatcattcttgttgaacctctttatttatagtcacattgtaatattgaaaataccgatgtgttactcagacaaagcttataaaggtgttaaatgaataacagaaccatttttctgctattctgtgcaatttccaatgagttcaacttgtagcagagatatatacttaaggcgcgttacatgaa

SEQ ID NO: 878 - DNA, 689 bp, Zea mays
  misc_feature (61)..(61): n is a, c, g, or t
  misc_feature (132)..(132): n is a, c, g, or t
  misc_feature (194)..(203): n is a, c, g, or t
  misc_feature (232)..(232): n is a, c, g, or t
  misc_feature (417)..(419): n is a, c, g, or t
  misc_feature (579)..(579): n is a, c, g, or t
  misc_feature (628)..(628): n is a, c, g, or t
  misc_feature (631)..(631): n is a, c, g, or t
  misc_feature (647)..(650): n is a, c, g, or t
  misc_feature (668)..(671): n is a, c, g, or t
  misc_feature (678)..(679): n is a, c, g, or t
  unsure (1)..(689): unsure at all n locations
agagcaccatgggtaattaaatttccttggagcaaaggttaagaataattaactttctctnttatttttcatcacagcatgtaaagagataaattttttgaattactcccttattctaagttcatctaaatnctactcccttattctaagttcatctaaattctactcccttattctaagcagtctgctttcannnnnnnnnnacgcttgatactcacaacacacttgattnatatgattttgtgctatgcatctcaatgcttgattctgtaaaattacttgtcatatactctctagcatttggaggtttaaaatgtcaggtttgaactatttttccatacaggtttctctccagatcgtgtagctgtcagttctctattggcagttggagctgtccatcagcatcttgtcttgaannntgagaggacacgcatagggttgcttgttgattcagctgaacctcgtgaagtgcaccatttctgtagccttcttggatttggtgcagatgctatatgcccttatttggctattgaagccatatggcggttacagattgatgagaaaatacctcttcaagangacggacagctgtatccaaaggaacttattgacaagtatttctatgctnctnacaatggaataatgannnntcttgcaaagatggggannnncaccctnncgtcgtacaa

SEQ ID NO: 879 - DNA, 702 bp, Zea mays
  misc_feature (4)..(4): n is a, c, g, or t
  misc_feature (145)..(145): n is a, c, g, or t
  misc_feature (268)..(268): n is a, c, g, or t
  misc_feature (330)..(337): n is a, c, g, or t
  misc_feature (386)..(394): n is a, c, g, or t
  unsure (1)..(702): unsure at all n locations
ctangggcggcttgtctggctccacgttacgagcaggaaaaccggatgagcaaccgacgattagatagcacatccaacacaacacaatcacacaccagacgactccagaccagactgacagtacatacatctgaggtagaggttnaccgcgtggttgaggaagccgctgccccggacgccggtgagcaggctcgttatgggcacgaacgacatggagatgacgtccgggaagccggtgatggtggagagccacttgccgtggccctgnccgctgtcgacgccgcctctcctgacgtgaatgcacaccatgtcctgcgaggatcccaccannnnnnnngggcgttcgttattcacattttcttggtgacgagcagtgcagtagaatnnnnnnnnngcaaaaccgcaacagtacgtgcttgcttacatccttgtgagacacgacgggtgatctgaaggactgccaggcggccgatccgggcccaacgtttagcccctgcgacaacctgccgcctcccgcggtggaagaattggaacttgcggtggaatcctccgagaacctgtcgtcggcgagctccttgagccgggcctgcacgtcgctctgcgtgaggctggagcccttgagctgcttcacgcacaccacgtccttgcctcccatcttcaccccgacgatgacgtgagtcccgtacttgtcgatgaacctgc

SEQ ID NO: 880 - DNA, 1331 bp, Zea mays
  misc_feature (50)..(50): n is a, c, g, or t
  misc_feature (585)..(588): n is a, c, g, or t
  misc_feature (628)..(628): n is a, c, g, or t
  misc_feature (638)..(639): n is a, c, g, or t
  misc_feature (694)..(696): n is a, c, g, or t
  misc_feature (702)..(704): n is a, c, g, or t
  misc_feature (712)..(716): n is a, c, g, or t
  misc_feature (718)..(721): n is a, c, g, or t
  misc_feature (1324)..(1329): n is a, c, g, or t
  unsure (1)..(1331): unsure at all n locations
ttccatagctgacaatgtcactatgtgctggaccaatccattttacattnactgttcgctccagtgcatccacatcactcactattgccgttcgcggacatcttgcagcatcttctacagtcagtttttctaggacaaattgacctggccaaaaatcatggtcaccaagggtactcacagggagtaatgcctggggttctagaccaagagatacagttccattctgccacagaacatcaacagtgctctttgtcttggcaacaacaaatgtttgagaacaatctgaaccataactttcaaaatacatgtgtgcatgagagtcacacttctgatcttcactaagaatacaagacttgccagaatccatccagaggcatccattgttgtcagtcataagagcacaccaatcacctagttgccaattagcgtaagggaaacatgacagcaaggtgagcttctttgggtcctgaatgtttggaggacttgatgatttatctccccaaacattggttacagatgtgatccagttcacatgcaccagccctacatcgacatgagagacaataccatcatctctactgggcnnnnatgatccacataaccatgttgctgacttggaaactgacgnatcgactatnntcacacgttggccaggataataaaagtaaggtgcatcttcaaaaagaacaggagnnntgggcnnnagtacatnnnnntnnnntaacaggatttcacactttgctccatcactgaataaaagtgtgacaagatcaaatgctcttatcactcgtccaatccatggccccataacaacgcagtcaccggaaacaaaagatctcactcttgatagcttcttgctgtttacatctttaattatgtcacctgagcttgtctccaagtcaacaaacattgcaacaccaacaacacgtcccagctgacctgagggatcagaaacagggcagactatatccccatgcagaaaccccctttcaaaagtcaaaaaattatcaatcttgccaatgctctcatccagactggacaagatgttttgggcatggtcactatatgtaaattcacattcttggtcttcactgtcactggtcccagtatatgactcactatccgagtcaattgtaaacaaatccatgatttcaaaccctgcaacgtcacacttggttattgatacggcataagacaaccttgttaagaaatgttactccataattacctaccttcttagtaaggtgtggctgcttgggtaacgtggtaatctcaagaacaaggaacaatatgcaaattgatgtccagaaggtcaatataccannnnnnca

SEQ ID NO: 881 - DNA, 627 bp, Zea mays
  misc_feature (131)..(131): n is a, c, g, or t
  misc_feature (170)..(170): n is a, c, g, or t
  misc_feature (206)..(206): n is a, c, g, or t
  misc_feature (247)..(247): n is a, c, g, or t
  misc_feature (274)..(274): n is a, c, g, or t
  misc_feature (324)..(324): n is a, c, g, or t
  misc_feature (338)..(339): n is a, c, g, or t
  misc_feature (341)..(341): n is a, c, g, or t
  misc_feature (363)..(363): n is a, c, g, or t
  misc_feature (554)..(554): n is a, c, g, or t
  misc_feature (556)..(560): n is a, c, g, or t
  misc_feature (562)..(616): n is a, c, g, or t
  misc_feature (621)..(625): n is a, c, g, or t
  unsure (1)..(627): unsure at all n locations
cgccggagccgtcaacaagatcagcgagagcgtgaagaacatcgagaagaacttcgacagcgcgctcggcctagaggagaagcgcgacgatgaagaaggtacgtacggcacggagacaataatgctacgancctcagtcctgccattcgcctaattcagtgtattgacgntgcattggtgcgtggttgtctgcgtattaacattgnaactgttgatatgacactgatagggtagtcaatggtgttantggttatgtttaattgatatttgacanatccatgtttgcggagaatgacatgtgctcattgcttattatcattggancgtgaccaaaaaanncncctatcacccgatcaatttctncgtgaagtcaaaattcagtctattagtctgttgaattctgtgctattgaatggtttaggcatattttcaaacctatgtcctcttacaagtgttggaactgtaacaccttttgcactctgtctgagttgctgatatctgtaggaccgattcatttgctagtgctggctaagagcttcacaatggaagcattntnnnnntnnnnnnnnnnnnnnnnnnnnnnnnnnnnnnnnnnnnnnnnnnnnnnnnnnnnnnnttttnnnnngc

SEQ ID NO: 882 - DNA, 731 bp, Zea mays
  misc_feature (123)..(123): n is a, c, g, or t
  misc_feature (275)..(275): n is a, c, g, or t
  misc_feature (461)..(461): n is a, c, g, or t
  misc_feature (523)..(523): n is a, c, g, or t
  misc_feature (566)..(566): n is a, c, g, or t
  misc_feature (582)..(582): n is a, c, g, or t
  misc_feature (621)..(622): n is a, c, g, or t
  misc_feature (642)..(642): n is a, c, g, or t
  misc_feature (644)..(645): n is a, c, g, or t
  misc_feature (647)..(652): n is a, c, g, or t
  misc_feature (657)..(662): n is a, c, g, or t
  misc_feature (671)..(673): n is a, c, g, or t
  misc_feature (677)..(684): n is a, c, g, or t
  misc_feature (687)..(687): n is a, c, g, or t
  misc_feature (690)..(692): n is a, c, g, or t
  misc_feature (694)..(694): n is a, c, g, or t
  misc_feature (697)..(719): n is a, c, g, or t
  misc_feature (721)..(721): n is a, c, g, or t
  misc_feature (723)..(729): n is a, c, g, or t
  unsure (1)..(731): unsure at all n locations
tagctatgttctgtttcttgtatgctttcagaaaccaaaagtcattgggctgtcataataacttctcgtcaatggattcaactatagcagaactgtagagttgaatagagataaggtaaatcngtctaaaaattcactaggctagaaagccaaactggatatagaaattttagttgtgaggcagctgctaagttacatcagatagagaaacagttagataaaaaatggtctctagaggaggtgaagattaggcagaattccagagacagagattngctaggaggcagaaatactgcatattttcaagcagtaaccaatcaaagcaggaaaaagaaaatagattgtctagagggatctaatgggttagtatatgatcacaaaggtatggaggaagtggttgtagatttttataagaatgtctttgtaaaggatgaagaggctggagccaaattaacccaagngttctgggatgtagatgataagtaactagagaagagaatgagttgttgattgctctttttanttaaattgagatcaaggatgctgttatcagtgttatgttgaangagctatggtttaccntttttttattttaccataagttttgggatctagtcaaannagacatagttgcttagtttnannannnnnntaaannnnnnctggatctnnntagnnnnnnnnttnatnnngntcnnnnnnnnnnnnnnnnnnnnnnntncnnnnnnnct

SEQ ID NO: 883 - DNA, 497 bp, Zea mays
  misc_feature (2)..(4): n is a, c, g, or t
  misc_feature (7)..(8): n is a, c, g, or t
  misc_feature (134)..(135): n is a, c, g, or t
  misc_feature (182)..(182): n is a, c, g, or t
  misc_feature (184)..(184): n is a, c, g, or t
  misc_feature (449)..(451): n is a, c, g, or t
  misc_feature (458)..(464): n is a, c, g, or t
  misc_feature (473)..(474): n is a, c, g, or t
  misc_feature (477)..(486): n is a, c, g, or t
  misc_feature (493)..(496): n is a, c, g, or t
  unsure (1)..(497): unsure at all n locations
annnggnnagggttacctttgtggtggtggtggtgctccagtgcactgccatgccactgctactggcctgctgctcttgtccgaacattccaaggacggtcgtaccgtacagatttttgggtgttcttttttgnncgattcagaaggggaacccagttcaaccagccacatgcctaccggcngncgtaccatgctcggcaagacgctgcacgtgatggaaccactaatcaatctccccatggaccaccgctgccaggcgtctttcagaaaccaaacgcaacgaacaggcaggcgcacggggattgcagagaaaaatcagggttcagctccacagagcgtgtgcagtgcagaccgaagccacgcttctgcgatctgagcctcaggagattgcttgcattgcagctctcacgcgacgcaaccatctcttactctgataggaaagtagagtnnntgtgttnnnnnnntagcacacnngcnnnnnnnnnngagatannnnt

SEQ ID NO: 884 - DNA, 898 bp, Zea mays
  misc_feature (42)..(42): n is a, c, g, or t
  misc_feature (72)..(72): n is a, c, g, or t
  misc_feature (119)..(119): n is a, c, g, or t
  misc_feature (127)..(127): n is a, c, g, or t
  misc_feature (209)..(209): n is a, c, g, or t
  misc_feature (229)..(231): n is a, c, g, or t
  misc_feature (244)..(244): n is a, c, g, or t
  misc_feature (260)..(260): n is a, c, g, or t
  misc_feature (273)..(273): n is a, c, g, or t
  misc_feature (350)..(350): n is a, c, g, or t
  misc_feature (429)..(430): n is a, c, g, or t
  misc_feature (544)..(544): n is a, c, g, or t
  misc_feature (605)..(605): n is a, c, g, or t
  misc_feature (658)..(658): n is a, c, g, or t
  misc_feature (690)..(690): n is a, c, g, or t
  misc_feature (851)..(851): n is a, c, g, or t
  misc_feature (885)..(892): n is a, c, g, or t
  unsure (1)..(898): unsure at all n locations
cctggcagagaacacacgatgcaagtagagtcaattaggagnggtgttcttggtggtggtcatttcttcttntgggagatagaaatatttcggctcctcagaaacttaatatgttcctnccccactngctcacctctttgtttgttatggagacgttccttccaaccctggcattcatgtcgatgatgcagttgctgcaacgcatcaanagaagggcttattaaaccannntgttatgacacanaatacttttctttttngttccttcttccntcaaggttcaagccaagcgctcaccttatcttcgtgttctcccctacgccaatgggcaccttgccctctgccagtanccttgagatctcgtcttcggtctcatacaaatccgcacccatcatcatggtattctgcaaagcaccgttcgcgtcagtnnctgcgggcgctcaatacagatacaagactgagcagtcatcgacgatgaacaagcaagcgaaccttgagctcgcatccagagtttaggcgtgagcgaacaccaacaatagagtgntcgatggcacactcacgcaagaagcagccgtgtgaaatgatcgcgtctttaatctgcacangttgaatccaaaggtcaaataggcacaagctcatactacagtttacaggtcanaggcaccattcattccatgcataggaagcgcntaccctgcacttatccgacttcgttggtggcaagtaccgaggggaagtgaagaatggtgttttcggatcgtaaaactcgaactttggaggctgcgacggggcatacgagatgaaaactgtattagtctggatggaaatctatcatttcaagatattttcantctaaatgcactggacagttaagagcacattagnnnnnnnnagagaa

SEQ ID NO: 885 - DNA, 1142 bp, Zea mays
  misc_feature (884)..(886): n is a, c, g, or t
  misc_feature (927)..(927): n is a, c, g, or t
  unsure (1)..(1142): unsure at all n locations
tgaaacacatgccgagttgcctttggttgaggtgcagattcctccagttcatttgcttttactatagttgaaatctcgtcttttgcattggagctggaaaatttgtcataaagtttgagctgcaatagactgagatcacaatatctatcctggattatcttctctggaagatcagataaaacttcatcctttgttcttctcagtagaaacggcatgacctggtacagcatgttcaaatttatttatctacaaaaggtcatttgtaatacaattataaataataaatacctgcttatgcagtgcctccattgcaagaataccagcttcagcatcctttgctgaacatttagaatctttggcagctagcaagggttttccatatgcagcttggaactgtaaaggacaacgggcttcagtacagtatatttcatacaagaacagactcaggtagattcaaagagaacatgtactcagcaggacaaagactgccccaacggtatagtttaaaagaaacatccgttttcaaaaggaccgagacaccccaaaccctgacagttgcagatcttacaccataacctagactgccggctacagccaccagatagagtcccgtcaatacccctagataagaccgcaccactcacatagaccaccgctcacacacgccgactgccaccattaccatagttttatgggttgctagtgagggatgtttttaaacagccttgaaattaatttccacggggagtctactcaagagtcataaccactaggctatgaaatctttcgcggagtaaacacaattcagtttgtttatttacacttcatttaaatagtcttatgtaaacgtagattaacataacaaacatctgttataaaaaaannnctggattgatctctagtgcaaaaatccagattagagaacanattagcattcccagacaaaacggctaactaagaagctatactagtaaaattgttagatgactatgtgcttatctctactgtaatgagcttggcctaacatatgtactgccactatatatcaatacaacccctacccaattaggattagggtttcgttctatccaacattggtatcaagccaatctttctccctcctcccttacccctagattctc

SEQ ID NO: 886 - DNA, 620 bp, Zea mays
  misc_feature (12)..(13): n is a, c, g, or t
  misc_feature (499)..(499): n is a, c, g, or t
  unsure (1)..(620): unsure at all n locations
gcttgatgatgnngtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctnacgaggcttcactagtgtagatggaacatggaagcgttgcttgtaagcaagtagtaacttgttccctgagctgtagcctccgcggctcgcacgatcaaagtgttcggccgtggctgcaggt

SEQ ID NO: 887 - DNA, 553 bp, Zea mays
  misc_feature (457)..(457): n is a, c, g, or t
  misc_feature (495)..(500): n is a, c, g, or t
  misc_feature (523)..(524): n is a, c, g, or t
  misc_feature (530)..(532): n is a, c, g, or t
  misc_feature (542)..(544): n is a, c, g, or t
  misc_feature (546)..(546): n is a, c, g, or t
  unsure (1)..(553): unsure at all n locations
cctgggggagtgatgaacggaggatagcacaggagcagaggagagggagggatagaaaagccgggaggggagccctatcctccgatcgtgtttggttggaccttggcagcaggggaaaagacgatcggggccgaaagcgagttgctgcaccgggatctttttctacaagcatcatatatatacgagcattcctctgctcgtcagatatttattttcgtcctctttcaacactcgcccacacattcagattcctcctcgtctctctccgcagaaaagaaaagtgcaaagggaatcggagaagagagagaacaaattaaaagagatgaatttacttgtgattaaccaggcgcactgacggggagttccatcatcattccgagcatcattagagcacaggacagaataatcacccccaaggcgataacagcaacatctgcaagcaagcatcacacccccnttccgcggttgttgctgttgttactgtcaactcccctnnnnnnctttccacaagagctgctggatnnaccacnnncactgactannntnagcacct

SEQ ID NO: 888 - DNA, 702 bp, Zea mays
  misc_feature (337)..(339): n is a, c, g, or t
  misc_feature (381)..(381): n is a, c, g, or t
  misc_feature (425)..(425): n is a, c, g, or t
  misc_feature (525)..(526): n is a, c, g, or t
  misc_feature (615)..(619): n is a, c, g, or t
  misc_feature (625)..(630): n is a, c, g, or t
  misc_feature (633)..(641): n is a, c, g, or t
  misc_feature (643)..(644): n is a, c, g, or t
  misc_feature (659)..(661): n is a, c, g, or t
  misc_feature (666)..(678): n is a, c, g, or t
  misc_feature (689)..(699): n is a, c, g, or t
  unsure (1)..(702): unsure at all n locations
ggctctagcttgaacagtttccttgcagctgcctcggcaagagcaaggtttccatgtaccacgcaaccggttagaagggctccccataggctcgccgctgacttgaatggtgacctgttgatgaagtccgtcgcttcatccaggtacccgcaccttgccaaaagatcaaccatgcacgcgtagttctcaacggtcggtgtcacgccgtatctgctctccatggcatcgaaatagtcccacccttcagtgatcaactccattgatctgcaagcagtgagcagcgctgtgaaggttatactgtctggcttcaatcctgctcctgctcctgcactagcannnctacacatgtcgtcgaacagcgctattgcctcacggccctgnccatgtgctgccagcccggtgagcatcgcattccaggacaccanattcttctcctcctgaatcctttcgaatatccgcgtcgcacttgccaggtttcctgacttggagtacatgtcgattagggctgttgcaacaaccatgtcnnggtcatacgctcttcttcgcagtgcgaagcaatgcagctccttccctttcgccagcaaagccagccctgcgcaagcccgcagcaacacnnnnntggtannnnnnctnnnnnnnnncnnggtccttctgcatcnnnttgannnnnnnnnnnnnatcttcgtagnnnnnnnnnnngca

SEQ ID NO: 889 - DNA, 498 bp, Zea mays
tgccgagctgctggtgatgctttaatgatcgatgtcaaggagttgtagtgacgcaacaggagatgatagagtgctgtcggatggatggagtgaaactgcctgctgccgaggtggccgacggagagcatgctgagttgaaaaggggtgttggccacgctccacgataagtatgttatgttgcccccctgtcattatttatttatttgtttatttcaatttaaatttgcatgcagttaggctggtaacgtgaacagtctctaatcacatgattgctgttccctgtggaaggaatacatgggtcaccacattgtgttatgctgccttggggcacgtagtttatcaacaacatatcttatgttttttttgtagaaaaaatcattcccgtatgcccttgactaggaaaacatatgtcggcccatcatctcagaaaattctcatcctggaagtgatgtcctaaggattgagattcagattctcatcctgtcggagcatcgccaa

SEQ ID NO: 890 - DNA, 595 bp, Zea mays
  misc_feature (485)..(486): n is a, c, g, or t
  misc_feature (514)..(514): n is a, c, g, or t
  misc_feature (591)..(594): n is a, c, g, or t
  unsure (1)..(595): unsure at all n locations
agctttctccatgttcttcaccacaggaggcctgatggttgcctgtaataatatatcacaaatagtaaggcaacaataacagaaaatgttatccagaaaaagaaaatgctcacctgaatttctggcagcatgccggtgttgtaagcaaacacaaggtctgctatggaacctatcgtagtgaagactcgagttgactgcgatgatttggggatgctgtaatcccttgcaggtgcggttatcccatctctcgacgacagcacaactgctatcacaatatacatgaggctgaaaagcgtggagaaccccaaccaaatcctgagggcagataaataagggattccaatggcgaaaagagcacagacgaatcctgatatcgcaatgcagtaagggagtttcagaactccatcatcactgaacagtccatacgtggcctgcaagtggaaataacagtatatgatattatatggcaaagagagagagagagnngaatgaaaataaatggtatgagtcgtcntcatacggtacggtacccctccctaccttgagagcttgtccagctaagatgataaagccagtgttgatcatgaaaannnna

SEQ ID NO: 891 - DNA, 1619 bp, Zea mays
caaactggcttcttgattggtactggaatgagactacaggcaagaatgtatcacatttaattcaggaatacctgaaaggaagatgtaaacttcgcatggcaggggatttacaccattttatgaggcactctgccactcgatcagaaaaaaataattttgtgcaacacttgcttgttaatggatgtggtggtgcctttttgcacccaacacatgttttcagaaactttgagaggttctctggaaccacctatgaatgcaaggcagcttatccatcctatgatgagtctactgggattgcattgggtaacatattgaagttccgcaaaaagaattggcagtttgacatcattggcggttttatatacttcattttggtgttttcaatgttcccacagtgtaatcttgttcgtatcttaaatgaagaaacttggtctgggcgtctgaaaagcttctcaggcacaatatggagtgctttgctttatatttttgagcactcttatgtctcttcagtaggaagtcttactttattgacggcgtcatattcattcgtaccatccaaactatcaaggaggagaagagctattataggcggcctccatgttttggcccatttaactgcagcactacttttaatgttgctgctggagttgggcattgaaatttgtattcgtaaccatttattggcaacttcaggttatcacactctgtatgaatggtatcgatccatggaaagtgagcattttccagatcctactggtcttcgtgctcgtttggagcaatggactctgggactgtatccagcatgtataaaatatcttatggcagcctttgacgtccctgaggtcatggctgtgacaagaataaatatatgcaagaacggaatgatgtctctttcgcggagtgttctgatcatgtactacacttctgtgtttatctatttctggattttctcgactccagttgtttctctcatatttggtagttacctatacatctgcatcaattggttccacatacactttgatgaagccttctcgtcgctgcgcatcgcaaactacaaatccttcacaaggttccatgttaagaaggatggtgatctagaaatatttactcttgcagttgacaaggtcccaaaggactggaagttggatccgaggtgggaatcagagggacgagggcctcatcagctcagccatgaccggaagcatccaagcaagtggaggtcagcctcatcaactgaccctgtgagatctgtacgggttgttgatcatttcaccatcgaaagaacaagaaccccagatatggagccctcttcttgattgtgcagcccttactattacaaggagttgctactgctgctagaaaaattaacaataactagcttcaacacacagtattgtttttgtttccacatccagccaacttaggtggaccgaggtgatctgcccttgtcggcgtccccgctttactgacctcacctgcagcattgtaatctgtatagaaagaaaattcacctgctgcctattgcttgtattcaatcaaaggaactctaaaaaaagagtgttacagaagaatgttttgagaaagcaaagggatgaatcgattcatcatcatttacc

SEQ ID NO: 892 - DNA, 1422 bp, Zea mays
ttcagccagatcgagcctattgctgccaatactccataccatgtctgtataggaaatcatgagtatgattggccatcacaaccctggaaaccatggtgggctacatatggaacggacggtggaggcgaatgtggaataccttatagtgtcaagttcagaatgccgggcaattctattctacctacaggtaatggtggcccagacaccaggaatctttattactccttcgactcaggcgtggtgcatttcgtctacatgtcgaccgaaacaaattttgttcagggaagtgaccagcacaacttcttgaaaacggaccttgagaaggtgaaccgaagtagaacaccgtttgttgtttttcagggccaccgccccatgtacacctcgagcgatgaaaccagggacgcggctttgaaacagcagatgctccagaatctggaaccgctgctggtgacatacaatgtgaccctcgcgctatggggacatgtccacaggtacgagaggttctgcccgatgaagaattcccaatgtgtcaacacttcatcaagcttccagtactctggcgctcctgtgcatcttgtgatcgggatgggcggccaagactggcaacctgtatggcaaccgaggcctgatcacccagacgtccctatctttcctcagcctgagcgttccatgtaccgcggtggcgagtttggatacgccagacttgtggcaacaagggagaagctaacactgacttatgtggggaaccatgatgggcaggtccatgatatggtggagatattttctggcctggtatcccccagtaacagtagtgttgctgaggcggtggatggaaccaaacttggcacaggagtcagcaccgtgcggaaaatttctccgctgtacttggaaatcggaggcagtgtgatgtttgcgctgctcctgggattttcctttgggatacttgtcaggagaaagaaagaagctgcccagtggactcaagtaaagaatgaggaatcatagtagtgttgccaataccgtgagcctggtgcagtggtggtgatccaaacttgtgtgggtgtaattactggagtagaacctaacaaagtgaaggcatttctgacttcttggggggctccgcgtcctcttggtacaactagtgtattgatagtcttgggaaatgaaggttctgatcgcatatctgttgttgtaatagttcaatgtataagcatgtaataagtgatataatgttcacattgctttggttgacacaagtgtgtaacatgtgctaccacaagtgattctgggcgtcctttgtagttgaaccatatttgttttatgatcctgcttttctgtatcatctgcctgcttttgttagcagatgtacggaatcttctgtacttggagtttatacctaaaaacatacttatatatttatattac

SEQ ID NO: 893 - DNA, 828 bp, Zea mays
  misc_feature (101)..(101): n is a, c, g, or t
  misc_feature (103)..(104): n is a, c, g, or t
  misc_feature (222)..(222): n is a, c, g, or t
  misc_feature (291)..(291): n is a, c, g, or t
  misc_feature (469)..(469): n is a, c, g, or t
  misc_feature (490)..(490): n is a, c, g, or t
  misc_feature (505)..(505): n is a, c, g, or t
  misc_feature (513)..(513): n is a, c, g, or t
  misc_feature (525)..(530): n is a, c, g, or t
  misc_feature (538)..(539): n is a, c, g, or t
  misc_feature (541)..(541): n is a, c, g, or t
  misc_feature (690)..(694): n is a, c, g, or t
  misc_feature (701)..(701): n is a, c, g, or t
  misc_feature (759)..(759): n is a, c, g, or t
  misc_feature (820)..(821): n is a, c, g, or t
  unsure (1)..(828): unsure at all n locations
cctcccatttgaagattcgaacctgatgtcgctctacaagaaggtttgacagtctctaccatgacaagagcttaagaagcgcttggttttccttctttttntnntccttaatggttgcttgacacttggtctgtttttttcatgcagatcttcaaagcggatttcagttgcccgtcctggttctccacaagcgcaaagaagctcatcaagaagatacttgancctaatgctaacaatgtgagttctgctgttcgtacataaccatcatttttaatccattctgttcagcanctctgtaggtatactaactgtgtgccatcgttttgtggcctgtgcagagaataactattgcagagctcattaacaacgagtggttcaagaaggggtatcagcctcccagatttgaaacagcagatgttaatctggatgacgtgaactccatcttcgatgaatccggggtaagcttttngcaccatacagttcatatttntgtattatctcacanctcattgnatgggcaagttnnnnnnaaaaaaanntngctttcaatgcaggagccagcacagcttgttgttgagaggagagaagaaagaccatcagtgatgaacgctttcgagttaatctctacgtctcagggcctcaatctcgggacgctcttcgagaagcaaacggtatgttcatgaccttaannnnnccgatgnccctgaacttcggatgataaagaaatgaaatccactagactgcaaccaaccacgatancctttgcctaactgaatgccctgcaatgcctctgtgttactagggttctgttaagcgagannacaaggt

SEQ ID NO: 894 - DNA, 705 bp, Zea mays
  misc_feature (13)..(13): n is a, c, g, or t
  misc_feature (128)..(128): n is a, c, g, or t
  misc_feature (225)..(225): n is a, c, g, or t
  misc_feature (284)..(284): n is a, c, g, or t
  misc_feature (286)..(286): n is a, c, g, or t
  misc_feature (385)..(387): n is a, c, g, or t
  misc_feature (414)..(414): n is a, c, g, or t
  misc_feature (587)..(588): n is a, c, g, or t
  misc_feature (593)..(593): n is a, c, g, or t
  misc_feature (643)..(644): n is a, c, g, or t
  misc_feature (678)..(678): n is a, c, g, or t
  misc_feature (680)..(684): n is a, c, g, or t
  misc_feature (688)..(691): n is a, c, g, or t
  misc_feature (694)..(694): n is a, c, g, or t
  misc_feature (702)..(703): n is a, c, g, or t
  unsure (1)..(705): unsure at all n locations
cagggtttgcccnccctgcaccgtcaccacggctgctgggagcttggaaggccatgtggatcacatctgctgacaggaaggccttgtagttgaggaacttgtcaatgaactcgtggttgcggtcaagngaaccaatgttctcatggaggagtatttccgcttcggtagttgattgctttatgcagaactcaaggaagcttacatctgaaaggggaagtgtattanaattaacagaagtaatacaaaagattgaattatcctaacttgaagcaagacacagttananaccatttgttccagtaagcttggcccattcactatccaaccaatctctgaagtccattgcctctgcatgatgacagatgttagaaatttgaacatgatnnnagtctttaaagaatacgagtaaaaaantttaggtataccagtctgcttgtttgtagcctctgctttccctttgccagattggtttgcagtagcagcagaaggaactggcaatctgcctgcctgagacttttgacgattcagtgcagaatgatccttcatcatggaacttctgctttggctcaacagacttggaaactcanncctgnttacgatatcatggtaataaaacataaaaattcttgcagatccgtatatnnatctttagtgatccaaatacaccaacgaaaatancnnnnnaaannnnttnaagtctcnnac

SEQ ID NO: 895 - DNA, 529 bp, Zea mays
  misc_feature (134)..(157): n is a, c, g, or t
  misc_feature (486)..(486): n is a, c, g, or t
  misc_feature (488)..(488): n is a, c, g, or t
  misc_feature (493)..(494): n is a, c, g, or t
  misc_feature (509)..(512): n is a, c, g, or t
  misc_feature (517)..(523): n is a, c, g, or t
  unsure (1)..(529): unsure at all n locations
agtatggaagtagacggttttcacatattgtacagaggaaagtaagtttgtaaatgcttgatagaattcccatgttcatttcaggttcttaaaccaaccaacttaaaataagcactacacttgtccagaatctnnnnnnnnnnnnnnnnnnnnnnnngaactagaatccagagaggaaaggcaaataaacgaaaaatacagcctcaaaacccatgatccatcattgcaaaacccagttaatcatccttctattcctaaaatacctgacacgccagaacacagaccatgactaccaccaaacacaagcaactagctaagcctctagctcctatgaactataggaaacaagctcaatgggacatcagaatttcctcaaacaacccaccacagccttaggttccaccccgacaccactgtcaacggcttgagctaacgaaaaatattaacagccatttagacccgccaacttctcagtttgtgttttcngntcctnnggggcgacatcattnnnnttctnnnnnnntttctc

SEQ ID NO: 896 - DNA, 671 bp, Zea mays
  misc_feature (26)..(26): n is a, c, g, or t
  misc_feature (65)..(65): n is a, c, g, or t
  misc_feature (148)..(148): n is a, c, g, or t
  misc_feature (324)..(324): n is a, c, g, or t
  misc_feature (555)..(555): n is a, c, g, or t
  misc_feature (578)..(578): n is a, c, g, or t
  misc_feature (601)..(601): n is a, c, g, or t
  misc_feature (623)..(626): n is a, c, g, or t
  misc_feature (632)..(633): n is a, c, g, or t
  misc_feature (645)..(646): n is a, c, g, or t
  misc_feature (651)..(656): n is a, c, g, or t
  misc_feature (661)..(661): n is a, c, g, or t
  misc_feature (668)..(670): n is a, c, g, or t
  unsure (1)..(671): unsure at all n locations
tgaaaatatattaccccaaattatancatagcagaccatgataattaatgagcgatgcaaacggngcttaaaatggaaattgcataggacatacaagagaaacattaggattttgtactgctactaggaaaatggtgagaaaatgganggtcaatatgcacgtgtgagcaataataagaaaagtaaaattcagacctttggacatgacaaccaatgaactcccattggttgatccagcaattgctgttatgtagtaacttttctcccactgctccattatccagtcctgtttataattagaaacagagttaggctttctggctnaataaattattaggcatgttcaagcttgactcagataactgtaccttgtggagaaaaactggtgagagctcgtaaacttgagaacagaaaccagttccagcgtccatgatgagtgcccaaaggtttgccgaggaagccacacaactaacgtaaagcccgtcatcattacccttttctatatgttgacttagccttgagtcagccacattgtaatggtacctaagaaacacncaacagatgttgacaaagcttancagcaatagttcatcacatcttnatgatcatgtttacagggctannnnttactnnagaaatgcagcnngtgtnnnnnnactancatgccnnnt

SEQ ID NO: 897 - DNA, 730 bp, Zea mays
  misc_feature (28)..(28): n is a, c, g, or t
  misc_feature (84)..(84): n is a, c, g, or t
  misc_feature (115)..(115): n is a, c, g, or t
  misc_feature (123)..(123): n is a, c, g, or t
  misc_feature (485)..(485): n is a, c, g, or t
  misc_feature (598)..(602): n is a, c, g, or t
  misc_feature (622)..(625): n is a, c, g, or t
  misc_feature (629)..(637): n is a, c, g, or t
  misc_feature (645)..(646): n is a, c, g, or t
  misc_feature (648)..(651): n is a, c, g, or t
  misc_feature (662)..(662): n is a, c, g, or t
  misc_feature (665)..(668): n is a, c, g, or t
  misc_feature (678)..(680): n is a, c, g, or t
  misc_feature (684)..(694): n is a, c, g, or t
  misc_feature (696)..(696): n is a, c, g, or t
  misc_feature (701)..(706): n is a, c, g, or t
  misc_feature (708)..(718): n is a, c, g, or t
  misc_feature (722)..(723): n is a, c, g, or t
  misc_feature (725)..(729): n is a, c, g, or t
  unsure (1)..(730): unsure at all n locations
gctaggagagccgcctgcgaaaccggtntcacctgctccgccgagggcaggaaagcgtgctcctacacgtgctgctaggggcanaaagggtgccactgggaaaggagtgcccccngcacctangactagaagaaagcggggtaatattgtcgacttggaagctgatccagcttgtgaagacccccctaaagctgtcaagggactggaagttgctgctgctgctgcacccaagaaccttcctttgaaggaggtagccgaggttggtgttctgaaaatgaatggtgtgagtgcagagaagattattggggctgaagatgaatcaacagcgacacctgtgccagagagggtattactttctcttttacattttttccccacatggactgctatttgccttctttatttcctactttatgttatctgtttgcagctcacctaattgcataaacacactggtttttactaactttacataaacacactgntttttttactagcttttattgaattgtcgcctgatattataaatgcaaaaaaggatataaatcatgtcgttttcccatgatgctttgcatgggagcccttaagtcaatgtagnnnnngggattgcatgtcatttatnnnnattnnnnnnnnnctattatnnannnnaatgaagcatnccnnnncctgtaaaannntacnnnnnnnnnnntnatgtnnnnnngnnnnnnnnnnnctannannnnna

SEQ ID NO: 898 - DNA, 487 bp, Zea mays
cacccggagccgcgccccgcggagcaccctgcgcccgttcctcaacaaggacccccgctcgtcggcctcctccgccaccagcacgcccgccaggcccgccgcgcccgggctaccgccggagcggagcggggtcctggacagcagctcgggcgcggaggcggcggggctcgtcgtcatcgcggactccgcgaagaggctcgggactgacctcgtggagaggagccgagaggccggcctaccggtgccgccctcggtgaccttggctgtgggactgggacgcgaggcgggcgctgcgggatcgccgcgccccgtcgcggccgcagctcttcctgctgccgcttttttcagcattgcgggcaagaaaccggagcccgagcctctgatccgaccaacttcagccgagcgcccgagcctgatcgacccgatcgatctacgcagagtagctagctagaaacagcaagatgtgtgggacgaaacggtcagctca

SEQ ID NO: 899 - DNA, 586 bp, Zea mays
  misc_feature (246)..(249): n is a, c, g, or t
  misc_feature (310)..(310): n is a, c, g, or t
  misc_feature (352)..(359): n is a, c, g, or t
  misc_feature (431)..(435): n is a, c, g, or t
  misc_feature (455)..(455): n is a, c, g, or t
  misc_feature (459)..(459): n is a, c, g, or t
  unsure (1)..(586): unsure at all n locations
gagctcccatcatcctcttcctagcttcctctactagaccgccacgacaccgcacggcagacggcgccgcacctcaagcgagcgaccgtgctctcactctcgcctcccccaacatcccgttcggcgcatccagactcagttcaccccccaaccaagccaagaacccaacgatagatgcatgcacctgcagctccccgctcatgctggcaaatccttcttgttcctgcgccgtactaccgcatgtannnncagtacaggcggcggggtgaccgaaggcgcgcagaggacgaagacaacgtggcacgcgcgncggtgtgggatctcgagggcagacgagggggggagggaggannnnnnnnggaagcagaggcacactcggctctgtcgctaggcttttaaatagcaaatgtatgtcccgggtagggtagggnnnnnatggggcgcggtggcggccncaancgagatggcgacgaggagaccgaagaagaggaaggtttggctgggaccggaccgaagaagatggtgacgataaggcggtcggctcacggcgtggaatccctgagccggccccggcgggacctcgtgc

SEQ ID NO: 900 - DNA, 404 bp, Zea mays
gggaagaagacaagagccgcatgcagaaaccatgcatcactgctctgctgctgcattattcaattcatagcagccaggtacatccgtacataccattgaagttccagctgacggggcgtccggtggcgacgtcctcgtagtagcgggcgaagacgaagttggaccagacgtggcagtcgaagccgtcgacgcggtcgcgccccaggtaagcggcgccgcgggccttccagtcgggcggcaggaggcccacggcgaactggaaggtgcggcaggacgcggagtcgaacaggaaggcggtgccgttgctccactccacgttccagctccagcgccgctcgccggacagctggtcgcggacgatgttcaggtcgcgccctcgcggccagtcgtagtacaggtcgatc

SEQ ID NO: 901 - DNA, 480 bp, Zea mays
  misc_feature (302)..(302): n is a, c, g, or t
  misc_feature (453)..(453): n is a, c, g, or t
  unsure (1)..(480): unsure at all n locations
ttatggatcacaatttataaacaaaccatagcccaggattcaatagtcgttgaagcacaaagcatgtgtaaacaagattgaacaatcaaggagatgaatatatcagcagtcctatcttccagctatattacatggctactgagagaatttagagaaagcacaaactgaatgttatgttaaaaaattatttagatactcgagattagagtttaacttcttaggtaaccattcatggaaaatacaaaatccatctcaaaccaaaataagtattaactataagaacagcatggaaccaacattgntgtgttattatatttctgtgatgaaaaagaaacccatacatttgaaagcctatgattctgtattggaaactactacacaatcaaaagttctacttaaatgagaagagcataatacaaagatcagctagtgtaaagaaataaacagagcagnggaccaaccttgttaagtgtgcgaaca

SEQ ID NO: 902 - DNA, 614 bp, Zea mays
acactcccatgtccagaccatgcatgccacctgggcccagccccagctctctgcttctctcacgtaggtgcagcaccgctgcatctctctccctcacgctgctctcacttgagtgccggcagcctgccctctgcggatctgtggctctgctccttccctctctcttgctgctccctcagatggatctctgttgtgttcccctcctggatcagccgccaccgctgcagatgatccaggcggtgctgcgcgctgtccccccacacatggtttggtggggatgagaggggaggtggctcaattgtcttcctggttggttccataccgttttcctctgtttcaactccgatctttttagatctctcactacttttggctaggtgacgggacaccttactccatgtgagtgcctcatcacataggcgtctgatgcctttgaaacactgagctgctgtacttgaacactaacagggtatcctacctacccttaggagtgtttgtttgggattataatctgcccagattatataatccaacaacttttgaactaagggtctgttgtttgtcttctagattatataagttggattatagtggaaggataagatggtaaaata

SEQ ID NO: 903 - DNA, 785 bp, Zea mays
  misc_feature (22)..(22): n is a, c, g, or t
  misc_feature (370)..(370): n is a, c, g, or t
  misc_feature (581)..(581): n is a, c, g, or t
  misc_feature (630)..(630): n is a, c, g, or t
  misc_feature (635)..(635): n is a, c, g, or t
  misc_feature (664)..(664): n is a, c, g, or t
  misc_feature (694)..(694): n is a, c, g, or t
  misc_feature (696)..(696): n is a, c, g, or t
  misc_feature (775)..(778): n is a, c, g, or t
  unsure (1)..(785): unsure at all n locations
ttgaacgttccccagcgccttntcgccgtcgtcgatgagtagcttctttcggagggccagcagctcctccccggcaccgcagatgtaggccgacgttcgcctgccggagagagttgctccttccatgctgtcaatgtagtcctgcatgtacagcacaaataagaccaatgtaccatgtcctaccgatgtttgcatgttgcaagataggaggaaaaaaaacattccaaggtgttcagacgccatgaaattgaaatgaaattgaaatggttgtttctgatggttttctgagccattggttaaaacaaactcaaggcattcagacattagttttctgggcctgttgatggctgtagctaggtcgatgtttttnatgtacaacaatacctgtttcgtgtaagatccagagaggaagaagtttttaacgggcgtcttctgatcaggcctgaatgggtcgtttccaggagcctcacggtacagcgattgtccgatctttaccacactggaccatgtaacttccaagccccgggaagatgggaacagttctacaacctgtgggaaaattacatgtgtttattactgangtgagctttggaagaatacaaaataacataagcagaagaaatctctctnttttnaagtgcattgaaatggggtcttgctcagntatgtgtaaagggaacagcagaaatttgancnaaacagaagctatttacaaacctacctgcttttgaaccttactaatgatctcctcgtttggcaatggcatgtatggatnnnnaggagtc

SEQ ID NO: 904 - DNA, 505 bp, Zea mays
  misc_feature (132)..(132): n is a, c, g, or t
  misc_feature (192)..(192): n is a, c, g, or t
  misc_feature (252)..(252): n is a, c, g, or t
  misc_feature (348)..(348): n is a, c, g, or t
  misc_feature (372)..(372): n is a, c, g, or t
  misc_feature (416)..(448): n is a, c, g, or t
  misc_feature (452)..(452): n is a, c, g, or t
  unsure (1)..(505): unsure at all n locations
ctgaaccttagctccaaccacttcaccgggccgctgccccgcgagctcgggcggctcgataagctcgtcgtgttggacttgtcgcgcaacgagatatccggccagatcccaggcgacatgagagggatgctnagcttgatcgaggtcaatctgtcgaacaaccggctcgcgggcgccataccggtgttcggnccgttccagaagagcgcggcctccagcttctccggcaatgccgagctgtgcggcgacccnctgaccgtagactgtggatcatcaatctatggctccagctatggaacggagacggaccacaggggaatatcttacagggtggccttggcagtcgtnggttcctgcgtgctcatcttctcnctggtgtcgttgctggtggcgttgttcatgtggcgcgagaggcnnnnnnnnnnnnnnnnnnnnnnnnnnnnnnnnncggnggaggtggcggtggcggcagcagccccacaggtggtggcctcggccgtgttcg

SEQ ID NO: 905 - DNA, 1534 bp, Zea mays
  misc_feature (303)..(323): n is a, c, g, or t
  misc_feature (1056)..(1132): n is a, c, g, or t
  unsure (1)..(1534): unsure at all n locations
agtgacagtgatgccacacggcaattttagccgcaacgctccccgtccgcgaaaaagaaaatttctttacttttcttcgaccgtcctaccctctccgctcccctcgccggagccgccgcggcggcgagaaagagagaacgcgctcctcttccttctcgactcgatctgccccttccagcccgctcgcccctcatcgagcggcctccgtagccctaggtgatccgcgcctccttccgccgcagcggaacaggacgcctgaccgtcgaccgtcgaagcgattcctctctcgcgggcgtcctcgtnnnnnnnnnnnnnnnnnnnnngtgccagtgggtcggcgcggggaggcatccgtccgggctacggtcgatttgttctccacttgctgttgaactttaaatagacaatggatctggagacagaaaatcgtcttgcttctttactacttgaagaggcccgaagattacaattagaggctaacagggaaggtgttcaagcatatctgcgaaaacctaatgttaggcatcgtccaaactcacggttcctcacagccacagttcgtggagttcagcaagcaaatcgtgttgtggaggtcaatgaaatgtggcgtgccagggaaaaggaactggagttggagtcaaaaatgaaaggcagaagtagcagaagtaaagatcatggtgattttagaggtgagaagcgcaaaagtgaaagaaaccatagctccagctcaaggattgaacaagaagggaccacttatgatacttcgtactcagaccaggaggatggtctcagggatgatgaaattgaaagacttctttattcaagggcgaagcgaggacgtggggctgttggttccaggatggacgagcctggtccataccttgattctctgtcccatcatcaggacaatggacctagcccggacatacgtgtggaagaaaaatgggaacgcagagtacaaggcccagagaagcctccattttggggatgcaagtctctcgatggtcattggcgcttgggcacattggatggaaggccatcaagctctgaaccacnnnnnnnnnnnnnnnnnnnnnnnnnnnnnnnnnnnnnnnnnnnnnnnnnnnnnnnnnnnnnnnnnnnnnnnnnnnnntccaaacatcgccaccaccgccatcgcagaagcagcaggagtgagtgagtgatgttgcctgttagcagaacagaaaaaaatggacacaacggttctgccatggccatgagacaagctagctgactgttcctgtgtcttgaaacctgtattgtatggaaacgggatattgtgtaggcttatacaatacaatgttgcgatgacacattgttggttgaagttttatcactttgattaacatctgcaacaggaggttttttcttctctttttcctatactatattgggcgtcgaatattggagtccgaggagcctgttcttcaagcagggcagcctgtcagttggggtttgtagctgaataaaactgtgtatggatgcgtaggccatcaatagctcttagtcaaaa

SEQ ID NO: 906 - DNA, 539 bp, Zea mays
ctggttgtaaatccgccactgcctatcaccttgttttggcaaatttaatgaataatactagtttccccctctgttatttgtaagcaccatttacctttgtttattgctttcaaatattctccagccttttattcctgttactgcctaccacatttgttattcttattcctgttggaattgaattactttcttgatatgaaaaaaaggattagtggatgctatacactagtcgacccttcaagtttctagcaagtccaaagtaatggaatatgcgacaaagaaaaggaagaagttagaaaattagattatactggttgctaactttagataactttgagctgtatgtatattgaagctagttagaaagctagaaatagtgttgtgctagcgtcggatagcctttagctgtttatgtgtgtgtgaagagataataaagatattagtttgaagaatgccacatcccactgatttgccatatccaattcctaacaattccaacgtgcttctggagagaatggcaaattgtttccgacctgtgc

SEQ ID NO: 907 - DNA, 639 bp, Zea mays
  misc_feature (141)..(141): n is a, c, g, or t
  misc_feature (149)..(149): n is a, c, g, or t
  misc_feature (287)..(287): n is a, c, g, or t
  misc_feature (416)..(417): n is a, c, g, or t
  misc_feature (509)..(512): n is a, c, g, or t
  misc_feature (522)..(522): n is a, c, g, or t
  misc_feature (541)..(543): n is a, c, g, or t
  misc_feature (550)..(551): n is a, c, g, or t
  misc_feature (557)..(559): n is a, c, g, or t
  misc_feature (567)..(568): n is a, c, g, or t
  misc_feature (570)..(570): n is a, c, g, or t
  misc_feature (572)..(572): n is a, c, g, or t
  misc_feature (579)..(638): n is a, c, g, or t
  unsure (1)..(639): unsure at all n locations
gtacttatcagaacacagattgccagaaaatatcgtcgcaacaactagtgctgctgatgctttagcaggagctgatttctgcttccatgctgttccggttcaggtattcacggttcttcacgaagcattatgctcgttgcngacatttngtcctcttgactctcttactttttgtggcagttcagttcatcctttcttgaaagtatttcaacacatgttgatccaaagttgccattcatatcacttagcaaagggctggaactcaatacccttcggacaatgtctanaatcatcccacgagcattgggaaatcgccgccaaccgtttgttgttctgtcaggaccatcatttgctgtagagttaatgaacaaattgcctacaggtctgttgatatcattaatattgttaacctgctnngtcacttttttttcaagcttaatgttgatgctgagttatttgtacctgtattcctttgaacttcttcacatatctatatatgaaagaacaannnntgggtttgangacaccaaaacaaccctannncaatcannaaattnnnagaaaagnnangnaaacgannnnnnnnnnnnnnnnnnnnnnnnnnnnnnnnnnnnnnnnnnnnnnnnnnnnnnnnnnnnt

SEQ ID NO: 908 - DNA, 638 bp, Zea mays
  misc_feature (35)..(35): n is a, c, g, or t
  misc_feature (534)..(534): n is a, c, g, or t
  misc_feature (543)..(544): n is a, c, g, or t
  misc_feature (603)..(604): n is a, c, g, or t
  misc_feature (608)..(614): n is a, c, g, or t
  misc_feature (616)..(620): n is a, c, g, or t
  misc_feature (623)..(628): n is a, c, g, or t
  misc_feature (633)..(634): n is a, c, g, or t
  unsure (1)..(638): unsure at all n locations
caagaccgtccggatctggaagcgcgcccctgacngcgcctggcagtgctcggtaactagcgccaccctcgtccctcctctccccgaagtgcggctccgtccgtttggtttaaaattacgggtttgacgcgtgtcgtagcttaatctcgtcgcttggttcggggcaggatgtgctggaagacacgcacaaccgcacggtgaggtcctgcgcctggtcccccaacgggaagctgctcgccaccgcgagcttcgacgccaccacggcagtgtgggagtacaacggcgccgactttgagtgcgtcgccacgctggagttgagtttgctaagcttggcaaggatcaggatcggtgcccacaccacttgctgtgctttctgtggatgctgacctctgtgctctgggcgtgcaggggcacgacaacgaggtgaagagcgtgtcatggagcccgtctgggtcactgctcgccacatgcagccgggacaagatggtgtggatatgggaggtgctgccagggaacgagttcgagtgtgtctcngtgctgccnngccacacgcaggacgtcaagatggtgcagtggcacccaattcttgacattttggtctcnntcannnnnnntnnnnncannnnnntatgnncctg

SEQ ID NO: 909 - DNA, 659 bp, Zea mays
  misc_feature (10)..(13): n is a, c, g, or t
  misc_feature (39)..(39): n is a, c, g, or t
  misc_feature (43)..(43): n is a, c, g, or t
  misc_feature (302)..(303): n is a, c, g, or t
  misc_feature (428)..(428): n is a, c, g, or t
  misc_feature (510)..(512): n is a, c, g, or t
  misc_feature (543)..(543): n is a, c, g, or t
  misc_feature (545)..(545): n is a, c, g, or t
  misc_feature (554)..(554): n is a, c, g, or t
  misc_feature (560)..(560): n is a, c, g, or t
  misc_feature (578)..(578): n is a, c, g, or t
  misc_feature (645)..(648): n is a, c, g, or t
  misc_feature (651)..(653): n is a, c, g, or t
  misc_feature (655)..(655): n is a, c, g, or t
  unsure (1)..(659): unsure at all n locations
cgctgggagnnnnacatctggtgagcactctcgacgacngctnccagccaatcaccacctctcagccgcataattcgttttgttctcatcaacgcttgcacttagtaaccgttcgtttgtgtcgtccaattgtgcagggactgcgggaagcaggtctacctcggtgagctcaaattctagtctccctgctcaagctactgctaacttttagtctgctggccttgattctgttgtgctggtgttgtttttttttcctttcaggtggatttgatactgcgcacgccgcagcaaggtttgacttnncactgatgcattcaaatgtgactatctgtggaaattaattttgtttgttgatgtgctgtgattattgaattggattgtgcagggcctatgatcgcgctgccatcaagttcagaggccttgacgcngacatcaactttcagttgaaggactatgaagatgacttgaagcaggtaatctgtgtaagatgtgtgatgatgtttttttttnnncagttttctgtgcttagctgttcttcacgcngngcgtgtgtnattgancgatcctgattggttagnttgtgtgctcctagatgaggaattggactaaggaggagtttgttcacatactccgacgtcaaagcannnngtnnncngggg

SEQ ID NO: 910 - DNA, 761 bp, Zea mays
  misc_feature (18)..(18): n is a, c, g, or t
  unsure (1)..(761): unsure at all n locations
gggcacagcttcaccgtnacccacgcatgcgcgtaatcctgcaggtgcagctaccggcatcctatcgcggcttcgcttcgagacggaaggctgtcccgcgaggtgtggagccgagaggggttcgccgtccgagaagggttcacatcacctcttcctctgctccccctccggtctgtcttcggggtctcccattggtggctgcagttgttttgatgggaactcagtaaccgctcgagaggagaggaaaggagcggatgctcaactgtagcaggaagatgggtagatccgcgagtgttcttcaagtccttctggtttccgcaaccatcgttgttgctcagacccaatgggctagtggtgtatggggcatgtactgcgaggacttgacagcgagtgtagaaaggccgcacagggcctcggtaaccgatttcggcgccgtcggagatggtgcgactcttaacacgaaggcgtttcagaatgcgctcttccacctcgactcattcgcgaagaagggcggggcgcagctgttcgtgcctgctgggaggtggttgactgggagttttagcctgatcagccatctcacgctgtcgctggacaaggacgcagtgattcttggatcaccagactcctctgactggccagtgattgatgctcttccatcttatgggcgcggtagagaactccccggcaaaagacatcaaagtctaatatttggatccaatcttaccgatgtgataataaccggtgccaatggcaccgtcgat

SEQ ID NO: 911 - DNA, 744 bp, Zea mays
  misc_feature (37)..(38): n is a, c, g, or t
  misc_feature (42)..(50): n is a, c, g, or t
  misc_feature (315)..(315): n is a, c, g, or t
  misc_feature (320)..(320): n is a, c, g, or t
  misc_feature (589)..(597): n is a, c, g, or t
  misc_feature (614)..(616): n is a, c, g, or t
  misc_feature (625)..(628): n is a, c, g, or t
  misc_feature (636)..(653): n is a, c, g, or t
  misc_feature (655)..(658): n is a, c, g, or t
  misc_feature (660)..(662): n is a, c, g, or t
  misc_feature (672)..(672): n is a, c, g, or t
  misc_feature (676)..(676): n is a, c, g, or t
  misc_feature (678)..(683): n is a, c, g, or t
  misc_feature (686)..(687): n is a, c, g, or t
  misc_feature (691)..(695): n is a, c, g, or t
  misc_feature (697)..(699): n is a, c, g, or t
  misc_feature (701)..(702): n is a, c, g, or t
  misc_feature (704)..(742): n is a, c, g, or t
  unsure (1)..(744): unsure at all n locations
agtgtggagaggcaaatgactgtttcctaaccagacnntctnnnnnnnnntctaatgacaagaaatttagcaaaaaactgtgtagctctgcggtacaagctactgacagctgccagaacatttctggaatgaaacttcctacctctgttggcgtggctgtagaacaaagtaccagcactgcattctcggaggccacaaaagtgtataaagagtttgagaagcaggttaagaggactgtataccttgacaacttgtcttgcctagctacagatggagtcattacgacggctttgaaccagttcggtagtgtcaaanacgtnagttttctgaccaactatacagttccatttgacattcccaaatctgcattagtagaaatggaaactgagaaggatgctgattctgtggtcaagatactagatgagttcccattcatgatatctgggatgccaaggcctgtgagggcgaagcatgccacagctgaaatgttcaatgaccgtccatgtaaacctggtataaagttagaattccgttgggtgggccctacagaccctgattatcataatgtcagaaagttcaagtttttgtnnnnnnnnnatgagttggagaacttnnnactaatcannnnaaaattcnnnnnnnnnnnnnnnnnncnnnntnnnttagcttatngatnannnnnnctnnattnnnnncnnnannannnnnnnnnnnnnnnnnnnnnnnnnnnnnnnnnnnnnnntg

SEQ ID NO: 912 - DNA, 717 bp, Zea mays
  misc_feature (611)..(611): n is a, c, g, or t
  misc_feature (615)..(615): n is a, c, g, or t
  misc_feature (655)..(665): n is a, c, g, or t
  misc_feature (667)..(673): n is a, c, g, or t
  misc_feature (679)..(680): n is a, c, g, or t
  misc_feature (684)..(684): n is a, c, g, or t
  misc_feature (692)..(692): n is a, c, g, or t
  misc_feature (695)..(696): n is a, c, g, or t
  misc_feature (699)..(700): n is a, c, g, or t
  misc_feature (702)..(703): n is a, c, g, or t
  misc_feature (709)..(716): n is a, c, g, or t
  unsure (1)..(717): unsure at all n locations
agaaattgaatgctaaacacagctccatcataccaaaggttatggaaactatattatataaaagttaccagtacacaagtacacaactggatgctagactgctagtagttagatagttagattgtcaagttgtcaattattggtgaacaatcagtttaatctgaaatttaatttaaaattcaagaacttcatacacaaaacaacatatatactctgcatcgatcaactgaaaatcactaaaaacaacagcacaggttagtacaactatatggggacaaatacttcactgagaagatgcacaaataaaggaaaagtgtggttaccaagcttctgcgttttagtacaaatgaactgtggtggagtaatgtaaccagaaaaggctgcaaaattccgagcagtttggcttctaattgccacacattttggccatacgcagcctataagctgtgccaaataggcccaacatgtctccactagtatctacacagccccaaataacagaattgtattttttttgtttcccaggatcaataatatcgctgttaacaatggttctgtaaaacagatcatgaaaacagattctctaatacaaacatttaagcagtattagnctantagcacgagtttaatcacattggcataaaagatggaatcnnnnnnnnnnncnnnnnnngggtgnntcgnatctgcanctnntgnntnntatgannnnnnnna

SEQ ID NO: 913 - DNA, 267 bp, Zea mays
  misc_feature (85)..(85): n is a, c, g, or t
  misc_feature (168)..(168): n is a, c, g, or t
  misc_feature (188)..(188): n is a, c, g, or t
  unsure (1)..(267): unsure at all n locations
gttgggtaaggtggatcttcttgcccacccagctcatctcgccggccatcttctctgcggggtcagttctctccgtttcgggggntgggcgcgtgcgtgtttggtgttcctctggctctagctcaagtctgaattttccaaactctgaacgctgctgctcttgctagnttggtcttgtcgtttataangaaggcaaagcctgtgtgcgtccgattgttttttactccctcacccattccgtgtcggtttacgggtttagccaccata

SEQ ID NO: 914 - DNA, 743 bp, Zea mays
cctaagaacaaggtttggatgtgttcagctgtcatctccacatcctgtcatatgctataaatgaaagtggcctggcagaaaattcaataatttcttgtcgctaaaattgcagtaacaagagtatatgaacaaaatttaaagaacatcttcgcattagacggatcatggttccatggctagtctttcaggttccaacgagtggggatagtcactcttccctcttccagaagataaaaccccaatcccactcccacccgcaccccaaaaaaaacccaaaaaaaatattactatgattaaggataaagccactgcatgcactgacgggcaccagtttagcgtataaacatcaatatctttgcagctactgctaatcgcactcagatttggtggccccgtcagagtatgccatgtttactttcttatcttcaaagcttgacttagcctgttcacagttgttggactccccattttttacttcagcaagtgcttgcaacaatgatgatgtatgctcaaggattgtgcgaagtttagattcatccattgtgttcaagtctgccatgttaaaatcagggataaccttttgtgtgggtgcactggatggatcatgttcttcagttgtctccatcacatttgagtttaccttgtttgtatctatttcatatggtttctctgtttgtaccttgataacaacactaggacacactgcaattctgttaacctccactgggccgtcgtctattggt

SEQ ID NO: 915 - DNA, 1024 bp, Zea mays
catgttttgaaagcacttgtaataactctaagcattgtgtaacaaacgtggtgctacacccataacaactatttggagaccttggtattgaaaatgctggtaatgcattggtgtcactagaacttttttggtgtagatatgtcattaaaacacggcggagcccttgcaatgtctgaacacttttgctcacagaatcaaaagcggctttgcatttttcaccatatagaacaccaagaagtgcaatcttgcgatttaccttgcatgtgggcccaggcaaggacaccatcatctgctggacagcatccttctgctgcgagtctacctcctgttcacctatgcttgacacaagcttgatgagaggctttttaaatcccatcagttgctggtaccgcctatgagcattttctgactctgactctattgctgccaatccttttctcatgtcatcatcattttccatgttgtcaaatgaaaaactaggttttgccatgaagtggaattcaaaacgaccatatttgctgtatccacactcattgcagagaaaagagtcaagattttcatagttaatatttctacactgccggcactgatatgcattttcatggcaattactacatatgccatgtttatcagtgacagacctgctacaccgtgggcattgcagtgactcaagggaagaagcttgaagattctcataaaatgaatcaagttcaatcatgaaattgcatgctgtaatcggaatgggaaattcaaccttcaattctgtctgattaaatgtaagatggcagctcttagcacgcttccaaagagtccaattattcttcaattctgataagtcagtcacaggcctgttgttgtaatacaggttaagtactttgaccgatttagacttacgagcatcataaacgttcattgtaactgactgtatagtaaagcttccagtgcattttattataattctgttgtcagtaaattttgtctcagacttgagggtttcaagcttcgtccttgaatacggaacatc

SEQ ID NO: 916 - DNA, 910 bp, Zea mays
  misc_feature (79)..(79): n is a, c, g, or t
  misc_feature (98)..(196): n is a, c, g, or t
  unsure (1)..(910): unsure at all n locations
aaagccaacaaattatatctggtgtttactgcaaccaagtgacgaatatcattcagtttctcaaaaaggggcgtacccngtgacgtaggcttcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtaggctctaccgctgcaccaggcccgcccttttgctgataatttatatgtatcgattgccgtctttcttatgcatctatggatctaaccttcaatgtgccttacctttcatgctgccctaatttccatggtttgttcatagaaataagaagcaccaactaacatagttcagtaagttctattaaactagccaatttcccttttagtttataagaccaggagaggtaaatgttgtggaaagaatgacaattatacttaccatctaggatactgtggtagcgaagaaggttcgtgataatggaaccaggatgaagagaatttgcagttatgttgacattatcttcctgttagacaaaatattgtatcatagatagagagaaatagttatagaacaccttaaaaaactggaaactgaatggtaactgtaaagagaacatataatcagcaaaatctgaaacattataatttttgtgattggatgatgagtgttccttgaatttgttacaccaagattagcaataaatgcactcaaacttccatgtccaagttggaacaactcactgtcactgcccaatgatctttatttaccaaaagctacaatttttaaaattcagatgcaaacatctttaaaaaataatgcaagtgatgttggtcacaaacagttgcaatgcataccaaggaccctgacatgcttgccgaacaatccagagct

SEQ ID NO: 917 - DNA, 538 bp, Zea mays
  misc_feature (142)..(143): n is a, c, g, or t
  misc_feature (435)..(435): n is a, c, g, or t
  misc_feature (441)..(441): n is a, c, g, or t
  unsure (1)..(538): unsure at all n locations
cccctgctgtcttctggttgagctctcagtaaccagcagtgaactagatttttggttgttgctgctatcatcattccttccatatgatctcctgtcacaagaaacaaggggttgagaagtaggcacccttggactcaatttnncatattgccctttggcggttctattaatcgttgaagctttccttctatcagtgctattgcttgtttgtggctgtgggagatcagatgaacctcctaatgggaagacagaagaatccactttgctgtaaaggtttgcagattttgaaggtttcattatcacaataggcgatttgaaagagccttcagcgttgctctcttcaggcatccacatgttgttggtgttacggttcagtctcatgttcgcactggccatctcttggtcatcatggtttccattatatagctttggcanaaatgnttcctcccgtttcttattttctaatagtccttttgcagaatccaaaatctgtttaagtgctctaaggtctttgtttggttgctgaaaatcaagatcc

SEQ ID NO: 918 - DNA, 624 bp, Zea mays
  misc_feature (43)..(44): n is a, c, g, or t
  misc_feature (174)..(174): n is a, c, g, or t
  misc_feature (341)..(342): n is a, c, g, or t
  misc_feature (347)..(348): n is a, c, g, or t
  unsure (1)..(624): unsure at all n locations
tcaagctcatcaactttgtccgctccaaggtgtgtcagcaacnnccttctgctgacagttatattttttttgggacacgttaatgcctgcagtagtgttacaggctcaactgctttgcttaggccctgattggttacgcttctccaccacgcttagattcgtggaaacgccaantttctcgcaatcattcgattttcacttattacttcacagataaactgtcgattctgtaagaacaaaaataatctaggtgtttgttgagattctcgcttattttcatccataagcggattataagcgaaaccaaacagggcctggtatgaacggctgattaaggttannatttnntcaatttatgagcgtactctgcttgatttctagctgttgttgattcataggttgcagagaaaaaatgctggagctgtggccaagcattctcttccaacacagaactctgcagccacttgcacacagtggagaattgcctaattgagggaaaggtgccatgggaggacgatgtgtacttgaaacctttcatggaagatgactcccttttgcacagcttgtcaatcgatgacgatgatgaagatggggactgtggagtgtcaatggaaaagggacaat

SEQ ID NO: 919 - DNA, 351 bp, Zea mays
  misc_feature (152)..(187): n is a, c, g, or t
  misc_feature (217)..(246): n is a, c, g, or t
  misc_feature (281)..(281): n is a, c, g, or t
  unsure (1)..(351): unsure at all n locations
agcaacgcagcgttacatgtctcaagcaaaactgaatcgccagaaaacatagaggcggcttcttcccatcctttattatgacccatgcacctgagtagttattctaaacaagtgtcatgctatgtcccgcaatgagatacgaatatcagatnnnnnnnnnnnnnnnnnnnnnnnnnnnnnnnnnnnnaacagtagcaacaacaaagccttttagttnnnnnnnnnnnnnnnnnnnnnnnnnnnnnngcatccattgaaaacaaatggtaatcaacaaaagnttgtggaagactcacatcacagttaagatctcatcactcgaatattcacaaatcgccttttgcaaatgct

SEQ ID NO: 920 - DNA, 750 bp, Zea mays
  misc_feature (3)..(9): n is a, c, g, or t
  misc_feature (17)..(21): n is a, c, g, or t
  misc_feature (644)..(644): n is a, c, g, or t
  misc_feature (659)..(663): n is a, c, g, or t
  misc_feature (688)..(692): n is a, c, g, or t
  misc_feature (721)..(723): n is a, c, g, or t
  misc_feature (725)..(749): n is a, c, g, or t
  unsure (1)..(750): unsure at all n locations
tannnnnnntattgaannnnnaaaacgaaatctcctgcaaaatctagcatcgtacagattaattcaaaaaaccagactgccgtgctcaggcctgcacgtaattcaaacctaactgcgccgcattctgctgaaatgtgctcatgtggataaagtggggctgtcaagtgcaagtcccattgtgttgagcccattgtcaacgtaaatagttgaaccagtgattgctgatgccaaaggagacaccaggaatgctgccgtgttccccacttcatctgttgatatgtaatgcaaaccgttttcagagaaagtaaagaagaaatctctacttttttccacttttcaggcaggaaaaatactagatataagggctagtttgggaacctcatttttcaaagggatttccattttcccaagaaaaattagtccattggacaaataggaatcccttggaaaaatagagttatcaaactagccctaaatgaaagaaggaaatttaacctgccaataattccttttgcagtggtgcattaacataagaatactctatcatcttctcgataaatccaatggcttttgctgctcggcttcccaatggacctaaggagacagatgcaaagcatgacacacaacaattcaagtgctgctangttattaaagcatcnnnnnaactgcaaatcccatatgtattatnnnnnaactttaaagcttatatcttctagttttnnntnnnnnnnnnnnnnnnnnnnnnnnnng

SEQ ID NO: 921 - DNA, 765 bp, Zea mays
  misc_feature (557)..(557): n is a, c, g, or t
  misc_feature (589)..(591): n is a, c, g, or t
  misc_feature (596)..(596): n is a, c, g, or t
  misc_feature (598)..(600): n is a, c, g, or t
  misc_feature (612)..(613): n is a, c, g, or t
  misc_feature (621)..(623): n is a, c, g, or t
  misc_feature (625)..(630): n is a, c, g, or t
  misc_feature (641)..(642): n is a, c, g, or t
  misc_feature (653)..(653): n is a, c, g, or t
  misc_feature (666)..(668): n is a, c, g, or t
  misc_feature (671)..(672): n is a, c, g, or t
  misc_feature (690)..(690): n is a, c, g, or t
  misc_feature (702)..(702): n is a, c, g, or t
  misc_feature (709)..(741): n is a, c, g, or t
  misc_feature (745)..(746): n is a, c, g, or t
  misc_feature (748)..(763): n is a, c, g, or t
  unsure (1)..(765): unsure at all n locations
tgctaggttacatgataggtttcatgaggcattagcagcagggaggttgtctaaggtaattatcatcttctacagcaattattttaaatgctcaaatcagcaaacatggcttaaatggctctgtttgacaaagccagttattgtgcataatctgcaattgggaaagctgatgaaccacagatttgcttatcagtaagctgttgcagaatcctggtgtccagcacagcttctgcttaatctgtggagaactgaggaataagctgtaccaaacaacgcctttggcattattccagctactcatgttagttttcagaaaaggaatcatgttatttccagtccaaatgtacgaagcttcctcatctggggaaacacctgtccaagcagtacatcccaaatgttatatatgcaagtgaacaaaaagatgctaactcaatatcatagtcacaagaaataaactgaagattaccatgactttggattaaagaaacacctctaaaaactcagcaccaaaaagaacgaccatataaacacttatcaaatgttgtttattccttgtnctgtggcagtttacaaaaaactcgatctgcgnnnaatangnnngcccccatgtanngtattaannngnnnnnnttatcacacanntcgagaaaaanctgaacccctgcnnngtnnatacacagcggcatatangcccatgtgagnatgactnnnnnnnnnnnnnnnnnnnnnnnnnnnnnnnnncgtnngnnnnnnnnnnnnnnnntt

SEQ ID NO: 922 - DNA, 348 bp, Zea mays
  misc_feature (26)..(26): n is a, c, g, or t
  misc_feature (41)..(41): n is a, c, g, or t
  misc_feature (72)..(74): n is a, c, g, or t
  misc_feature (76)..(76): n is a, c, g, or t
  misc_feature (234)..(234): n is a, c, g, or t
  misc_feature (240)..(240): n is a, c, g, or t
  misc_feature (283)..(283): n is a, c, g, or t
  misc_feature (338)..(338): n is a, c, g, or t
  unsure (1)..(348): unsure at all n locations
ccaggtactctctacagaacacgaanaagaacgagcaaggncagatggaaaagcaccgcgactgtgactgtnnncnaccgggcgtccatggcaggtgaggacgccgacgtcgtcgaccccgtgatcgggttggtgcgctggtagtaccacgggaaccacgggaggacggggttcggcggcggcggggctggcccagaggggaatccactgtacggtggggagaagcccgcgggnatcgcncccggcggggtcagctggaagctccctggcggaggtggcgganagctgccgccgaggccgccgccgcctccagtggacggttgcggtggcgggtagcngttgatggct

SEQ ID NO: 923 - DNA, 355 bp, Zea mays
ccacacatgatagttgcctagggactactcggggtagtttgtcttcctgggagtcgagtaattcgcggatcctctaaccatgtcgatcctccaaccgcacaccagtcaccacacaacggatcaccagcccacaattcctactctctccactatcatcatcacggtggctggatcaaggtggaggtgcgtgccttggcgacattatctgacctcgaggcatttgaattctcacgagtgcttaaactagatttgatgctaattattggcttatagcaggaacactagaacacacacaagcattcacagatgagcacacagtggttttggttagaactaataaagataatttttctca

SEQ ID NO: 924 - DNA, 517 bp, Zea mays
  misc_feature (499)..(499): n is a, c, g, or t
  misc_feature (501)..(505): n is a, c, g, or t
  misc_feature (507)..(507): n is a, c, g, or t
  misc_feature (509)..(515): n is a, c, g, or t
  unsure (1)..(517): unsure at all n locations
accaataactgctagcagtaacgaaagaaaacaaaaagctaccaaatttaagtacctatgaagcatatccattcctccaaaaccaggaatttaacagcaacaaatatcaatttgacacaccaaactcatgataataattcaatcagtaaagcatgtcgtatgcagaacatatatacaaaataaagcagaaggaaatgtttcatcacaggctttgcaaacaaggaccaaccttcaagctgccgtggtgtgacatcaaaatcctgccaccaaaccttatcaccatcagatggaagcttcactttgagaaatttagcagccaaaaagatagcacctgctgcaatatgatgaggctcgaattgcaggcaaagcgaagtacgcagtctgtacagtgcacaatattaagtgtagtagatacacaactgtgaactgcaatttcaaacgacagtaagggtagcactagcatacccatcatttacaaaattccaggcaacctgaggangnnnnntntnnnnnnnaa

SEQ ID NO: 925 - DNA, 513 bp, Zea mays
  misc_feature (59)..(59): n is a, c, g, or t
  misc_feature (87)..(87): n is a, c, g, or t
  misc_feature (105)..(105): n is a, c, g, or t
  misc_feature (144)..(146): n is a, c, g, or t
  misc_feature (271)..(282): n is a, c, g, or t
  misc_feature (413)..(413): n is a, c, g, or t
  misc_feature (488)..(488): n is a, c, g, or t
  misc_feature (504)..(504): n is a, c, g, or t
  unsure (1)..(513): unsure at all n locations
gtaaactctaaaacgtctagctttagtctacttttatgagaatcgatttgataaaaacnatctaaaattaacgtgaatacaaaatcngtaaagtcgcgacagtanaaatccatcactttctaaatttaaattatatagacttcnnnatcttactctgcacataattctcatgatgctctaattcttctcacaaccatattctccacagataaattcttagattattagaaaagcttgtcagaaaaaagatgaaacaaaccggtccaaaaannnnnnnnnnnnacgcagttagaaaactgaaccacccctacctcaattgacaaagtcaccatcaaccattgtaaacaagttcagaattctactgggctcgaattattttggaagttgctcatttaacagagcgctaagcagangacccaaaaatttcctcaatgaaacatttcgcagttcatgaaatcaacagactgcaacgaccaaaagatgccggnaaccccaacagttttnttttcccca

SEQ ID NO: 926 - DNA, 656 bp, Zea mays
  misc_feature (66)..(66): n is a, c, g, or t
  misc_feature (128)..(128): n is a, c, g, or t
  misc_feature (151)..(151): n is a, c, g, or t
  misc_feature (293)..(293): n is a, c, g, or t
  misc_feature (356)..(356): n is a, c, g, or t
  misc_feature (374)..(374): n is a, c, g, or t
  misc_feature (552)..(552): n is a, c, g, or t
  misc_feature (554)..(554): n is a, c, g, or t
  misc_feature (563)..(563): n is a, c, g, or t
  misc_feature (578)..(579): n is a, c, g, or t
  misc_feature (585)..(585): n is a, c, g, or t
  misc_feature (587)..(589): n is a, c, g, or t
  misc_feature (606)..(610): n is a, c, g, or t
  misc_feature (618)..(622): n is a, c, g, or t
  misc_feature (631)..(634): n is a, c, g, or t
  misc_feature (636)..(636): n is a, c, g, or t
  misc_feature (639)..(641): n is a, c, g, or t
  misc_feature (644)..(645): n is a, c, g, or t
  misc_feature (648)..(650): n is a, c, g, or t
  unsure (1)..(656): unsure at all n locations
gcaaccacttaacttcctcatttttctgctcacatgcattgcttgatacattaatttggggaaggnattttacagttaaaccagacatgttcattcatgtgttcaaggatactctactaccaaacaancagaatgacaaccaaagttggcnaagcacacatgtcaatgttcactacagggaggaatatatgtgtagtgcctaccaaaagctgcatggggcagtaagccaggaagcaatgatgagggaaatcataaataaaccaactcaatcaatgtcttttccttctagatgnatggatctcagtactcaccaatgaactgaaagccatttaatgtggcagatcaccaggctaatntctttttgaaccagtagnaaagtaggtggtctagtgggtagtggctaacagggctagatccatacatcagaatgcctacttttttggtccttagtatgcattgcattatcatgatttcgaagtccagtgcagttcattcagaatttctttgcatgaaatatctagtcataatcaccagtaatcaccacatgaacangnaccatctcnaaaatggtgaaaccnnttggantnnngcagtatgatcagtctnnnnncaatcgcnnnnntacacttgnnnncngtnnnacnntcnnngcatac

SEQ ID NO: 927 - DNA, 677 bp, Zea mays
  misc_feature (409)..(409): n is a, c, g, or t
  misc_feature (614)..(617): n is a, c, g, or t
  misc_feature (630)..(633): n is a, c, g, or t
  misc_feature (641)..(642): n is a, c, g, or t
  misc_feature (645)..(645): n is a, c, g, or t
  misc_feature (656)..(656): n is a, c, g, or t
  misc_feature (660)..(660): n is a, c, g, or t
  misc_feature (662)..(664): n is a, c, g, or t
  misc_feature (666)..(666): n is a, c, g, or t
  unsure (1)..(677): unsure at all n locations
gctacatgtatgtatttggctctggcttacttggtgcatttcttttccgtttctttgttgaggacaaaacttttccctgtaagttgctagcttaattttgatttgtctcagtcatataattttagttgtaacttacaagttttgtcttttccactcagatggttggacattagtcatggagattgtcccaggattttccctctatcggggcctatatgaacttggtcagtatgcattctcgggaagcagtataggaactactggtatgacctggagaagtctgaaagatcccctcaatggaatgcgtgatgttatgatcgtaatgagtgtagaatgggcagtgctgctcatattagcattctatttagatcaaacctctttgctaggcggtggtgtcaggaaaaatccntttttctgcttcagatgtttacagaagaaatgtgcaacatcattgcatgaacctagctttgtccaacaggattccaaagtcattctcgatatggagaaatctgatgttgctctagaagtaggttatccctcacactgatatttcttatacttctctacatacagtacatatgaatgacatttcattcgttgacattctatttcannnnaaagtagttgagnnnnttttgatnnatnccaatgcaaancaancnnncntctgtgataac

SEQ ID NO: 928 - DNA, 517 bp, Zea mays
  misc_feature (5)..(5): n is a, c, g, or t
  misc_feature (34)..(34): n is a, c, g, or t
  misc_feature (66)..(66): n is a, c, g, or t
  misc_feature (99)..(99): n is a, c, g, or t
  misc_feature (120)..(120): n is a, c, g, or t
  misc_feature (222)..(222): n is a, c, g, or t
  misc_feature (362)..(362): n is a, c, g, or t
  misc_feature (379)..(379): n is a, c, g, or t
  misc_feature (428)..(430): n is a, c, g, or t
  misc_feature (440)..(440): n is a, c, g, or t
  misc_feature (452)..(452): n is a, c, g, or t
  unsure (1)..(517): unsure at all n locations
cctgntttttttaaaaccacaacaaatacactgntctagccaatgaaaatccggttgtcatatganatgagtccagtttagaaaatctggtggagaatncagagtgccttcttttgtagnctcttttttattcatgatatataatattattgcagatactggataaggatcagtaggataggatggcttgcttctacagcctaaactacctgagcaattcgnaacatgtttctccaataaatatgatctgacaaaatccatgtgcgggatgttagtgcctgtatccagtgtaaccagcacttgggagatgtctcaagtgcaagatccatcgttgtgttatttttcatgtccaacacggttgnatttttgccaaacttanataaaagcacacaccatagacttttcattctgaacaccaacactataannnggccagaagnaacttatgtaanctttagagcaatctaacaacaatcatgctacgaatgacatttttaatctgattccctaggcaatg

SEQ ID NO: 929 - DNA, 810 bp, Zea mays
  misc_feature (142)..(142): n is a, c, g, or t
  misc_feature (169)..(169): n is a, c, g, or t
  misc_feature (241)..(241): n is a, c, g, or t
  misc_feature (352)..(352): n is a, c, g, or t
  misc_feature (423)..(423): n is a, c, g, or t
  misc_feature (448)..(448): n is a, c, g, or t
  unsure (1)..(810): unsure at all n locations
gaacctgatcccatacgagtacgtaattgctcgacaagggaatgagaggatagatagtattctaggccttggtccggcttcaaggaagaagagcatgcttgtcgtgtcagagttcatcggctgctcgccctccctgagcggngctatccgtgtgaacccttggaacatngattcagtagccgacgcaatggactacgcgctggagatgccggaaggggagaaggtgttgagacatgagaancaccacagatacgtgagcacgcacgacgtcgggtactgggcgaacagcttcctgcaagatcttgagcggatttgcctcgaccataacaggaggcgttgctggggcataggntttgggctgaagttcagggttgtggccctcgacccaaacttcaagaagcttgcggtggagcacttggtctnggcctaccggaggacgaagaagcgngtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggtaaaataataacttcctgctgtctcccaagcagttcgtgatctgctactgctggagagcacacacactaatcgctgatgctgtcgacggttgtgtaggctgagaagagacgcagaatgggagacatgcgttccggtgatagactgcagg

SEQ ID NO: 930 - DNA, 810 bp, Zea mays; identical to SEQ ID NO: 929
  misc_feature (142)..(142): n is a, c, g, or t
  misc_feature (169)..(169): n is a, c, g, or t
  misc_feature (241)..(241): n is a, c, g, or t
  misc_feature (352)..(352): n is a, c, g, or t
  misc_feature (423)..(423): n is a, c, g, or t
  misc_feature (448)..(448): n is a, c, g, or t
  unsure (1)..(810): unsure at all n locations

SEQ ID NO: 931 - DNA, 449 bp, Zea mays
  misc_feature (244)..(244): n is a, c, g, or t
  misc_feature (247)..(247): n is a, c, g, or t
  misc_feature (265)..(265): n is a, c, g, or t
  misc_feature (359)..(359): n is a, c, g, or t
  misc_feature (396)..(396): n is a, c, g, or t
  misc_feature (418)..(418): n is a, c, g, or t
  unsure (1)..(449): unsure at all n locations
ctgagcgaattgaggtgcggagtaacattttgcctgacagataacacaaccccattcagagggcggttgctggtccttggcaatttctggtggaaaatctcctgttttcttggcttcttcaagtaggtcctggacattcagttggtgtatcttcgctccaaattggtgctccaagtctaatttgcaatcagaatcagcttcaagtatgctacaatttgatcctggagtctgctctgtatgttgnggngcaatgttcggaagcacngtggcttctcgcgactcagaattccttgacaggttactgatttcgtccagtagagcttgaggcttagctaaaaggtgccctcgtaactccaatncatgagtagagttcgctaggcaatgggtagaactcancggaggtggcttctctgaatgntgtggtgcattgttcttagggcactctggtt

SEQ ID NO: 932 - DNA, 789 bp, Zea mays
  misc_feature (139)..(139): n is a, c, g, or t
  misc_feature (157)..(157): n is a, c, g, or t
  misc_feature (224)..(224): n is a, c, g, or t
  misc_feature (380)..(380): n is a, c, g, or t
  misc_feature (561)..(562): n is a, c, g, or t
  unsure (1)..(789): unsure at all n locations
ctatcatctgcaatataacacttgcacaggtattctatatttctttatctgctgtgtttggactattggataatggaagtagaatggtacctcttgtcccatttctttatcatatatttgtaatatgttttgcttatcnatgatgcttattgtgganactaagttgaaaggtgccacttcttttcttttgttccattttcatgtcaaggtaacagctcaaagtngtattttgaatttctgtctttcgaatcagttgcttcattgcttataaagtcatgtgccatagagaagcaaacaattagttagtcaacaactcaacatgccattgagaaacacaaagagcaaacatatagtcttagaactaacaatttgtgtcttgntaaactatttattttttatattttgtagatccacactgatgagacaaaaagcagtttgcaatttgcgagtagagcattacgtgtaacaaactgtgcatgcgttaatgaggtattaacatgtttctgttgcccactagattattgtttctattcattttgatataattgcataaatccttanncattatatatgtttgcagattttgacagatgctgcattattaaaacgccaaaggaaagaaatagaagagcttcgagcaaaacttagagtaagtattaaaaaatgtttcttaagaaataaatctattatccatacttctttaaaattgaaacttacattcttctgcctttagaaatctgaaagtgatcattgggaggaagaaattctgaatctgcgaaacacactact

SEQ ID NO: 933 - DNA, 943 bp, Zea mays
  misc_feature (9)..(15): n is a, c, g, or t
  misc_feature (23)..(30): n is a, c, g, or t
  misc_feature (40)..(40): n is a, c, g, or t
  misc_feature (42)..(42): n is a, c, g, or t
  misc_feature (53)..(53): n is a, c, g, or t
  misc_feature (217)..(227): n is a, c, g, or t
  misc_feature (266)..(266): n is a, c, g, or t
  misc_feature (444)..(444): n is a, c, g, or t
  misc_feature (517)..(517): n is a, c, g, or t
  misc_feature (519)..(520): n is a, c, g, or t
  misc_feature (522)..(524): n is a, c, g, or t
  misc_feature (630)..(630): n is a, c, g, or t
  misc_feature (774)..(774): n is a, c, g, or t
  unsure (1)..(943): unsure at all n locations
cctgaaatnnnnnnnaattgtgnnnnnnnncatcaccacnanttatgtacatntatcgcgtattcgaaaacaagctgcttgatttgaaaatgagagggtaatgtaaagcatacctttgtaatgatacaatcacaagcacccatacattcttccatctttgtaacaaagcctttcacctaatatttgaaatagaaaacaaggatttatgaagaaatcnnnnnnnnnnngtggtgtgaaatataagaggcatttttaattagacttgnttttttaatatatccatacgatgttgctgcagcagtatttagtctcatgtatttgaagttcaaaaatacacaactgctactagccaacaaacaatgtaccttggtttatgttcatttaagctgtctatgcagttgaaagggttgaagaataattcttttgttggggaaaaagcaacancaagaaactggtaaggcagttgtaattgtaatgttaaacttattggatattacaaatcagcttgcagggaagngnngnnnaagtacctgaactggaactttccaatttatggattgcaatcgattgaccagcttcttattacgcccacaaattacaagtatttgaccagtgggttcccctaggttntcatcatacagagaatcaccaagtgctttagcagtggcctcaataggacccatcccttcacccccacccattaatagaacagcaggcagatcttcatccatgcctaactctcttcgcagctcatcctattaaaaaggacaacantaggtactacagtcggtaagttctgaaagatagaaaagatccataaaaatcagtatgacaacgctatactgcaattagctgaagaaattttgtaccttcggtcgaacaggtttgacaaaagagggccggacagggaggccatagactttaatctgtgcgggcttcagtc

SEQ ID NO: 934 - DNA, 367 bp, Zea mays
cgagagaaggtgccaaatgacgccaaaaggggtaacaagatctacaagaaagagcttgctctttctctgctcctgctcaccgctgcgactcggagcctcttgtctgctcaggggattcatttctacttccttctgttccaggggatgtcattccttgccgttggcctcgatctaattggtgaacagataagttgattccttgcatgctattgttcttgttcagacagcatgggaatcacacatatgttcatacatacagtgatatcaaaattctaaatttcccattcatggtttagcgttttgcttcagaattgcaaccctgctcaacgacaaaggggagcgcaactgcctccagaaagcccaacag

SEQ ID NO: 935 - DNA, 775 bp, Zea mays
  misc_feature (111)..(111): n is a, c, g, or t
  misc_feature (301)..(306): n is a, c, g, or t
  misc_feature (310)..(311): n is a, c, g, or t
  misc_feature (347)..(347): n is a, c, g, or t
  misc_feature (367)..(370): n is a, c, g, or t
  unsure (1)..(775): unsure at all n locations
gccacctagtgagtgagatcactactactggtcagagggcgaacggtgaaaaggggtgtgggcgggcggaccagcagcttcgtcagcttttcccctgccctctctcgtagncgtagcaggcacaggaccagacatacctgcctcgaaaagacggtaaacagtttttagggactatatatacccctacatttctaaacatttctgagtggaattacaggtctaagatgacgccatttcgagctgaaactactgtacagattcggtcccggctcttcttttcctcgtctacactaccctaccnnnnnncccnnacggaagctcctctttttccaaagtttaccgggagnaggaggaggagcagagctgnnnnacgtgcgacggagaacacagacagtgtatgtgttattataagagagcgcacgcacgagcgcgaatgcatggaaagacatgtcacgcagggaaaggaaaaaatgcagcaatataatggaccaatgcaatccttagcttaccaggctcccgggcctcacgctgaggctgatctccttgcacgctagccccatggcgaggacggtgagggtccaggtgacaagggcggacgcggcggcggacatcatgctggccgggtacccctggctgacctcgtgcaggccggcgagcgaggtggagatgccgacgacgcccgtgacgagcgcgaagatgacgaagaaccccgtcgccaggttgccgatggggaagtagatcgggaacaggcgcaccggcggcgtcgcgcccttca

SEQ ID NO: 936 - DNA, 891 bp, Zea mays
  misc_feature (139)..(139): n is a, c, g, or t
  misc_feature (170)..(171): n is a, c, g, or t
  misc_feature (490)..(492): n is a, c, g, or t
  misc_feature (540)..(540): n is a, c, g, or t
  misc_feature (546)..(546): n is a, c, g, or t
  misc_feature (551)..(551): n is a, c, g, or t
  unsure (1)..(891): unsure at all n locations
ttctcttctagtaatgaacagtcagtgatgagagagagagagagagacagggggcacaccgggtcttgttggcgtcttgctggttccgggttgggacagcttcgccttcgatcgatcatgccatcctaattgactcctnattcggcgtctttcacttttattttttttcnngtaatgttgtacgaaagttcaaatgaaagggaggctatcattaggcagcgggcaccaacagaccggcagcgctagcagacagacacggacagagaactcgattccacctttcctttccatggggcaaaaataaaaaaaactgatcactcaacagctttatttgttgcacaaattgtgtaaacaatagtattataaatttataatgtgtagaaacaagacgccagccgtcccatgcaacgcaaaacggcagcgcagtgcgtacgcgacacacacaggcccgtctcaaaaccggccggggtcactgtgtggtggtggtggnnngcgggcgttcggtccggcgtcaacctcagagccctctctttaaatttngcctcnccccngtcgcgttggatccatcatccgttcccgatcgtccgcgctgacgtcgacgcgcgccacgattaatcaagctgacagacgtactgaagctgcgctggctgctctctgtttggaggatcatcatcatcaaacgaatgcatgatgaaggccggaggaggctgagcttatattagcgagtagttgacccgagcccgctgctgcactgcccacgcgcgcacgggtgcaggaagagcggaggacacatacggtttgctcaaggagagccgcctttgactcccatcccatggctgatcatatcgtcgacaataatgtgctcgcgaatgcgatagtgattctgtacct

SEQ ID NO: 937 - DNA, 367 bp, Zea mays
  misc_feature (39)..(39): n is a, c, g, or t
  unsure (1)..(367): unsure at all n locations
aacttggtgtcgttcctgaacaacgccaagggagccacngttggagatgtaagtccgccactgcactttgcagaacacagatgatcatcccgactcaacttgcctctatatgcaatcagtataatcatcgtactctgtttatttatctatgcatcaggctgtcaagaaccttggcctgttgggcctcttcactcgtggcctccctcttcgcatcctgatggtcggcaccctgactggcgctcaatgggtgatctatgattccttcaaagttatgattggactgtaagtattatatatgtgatcctgtgttggaccgtgattattaggctaatctgtcttgttaagagggctaaaacaactggtaatt

SEQ ID NO: 938 - DNA, 1286 bp, Zea mays
  misc_feature (5)..(9): n is a, c, g, or t
  misc_feature (123)..(123): n is a, c, g, or t
  misc_feature (133)..(133): n is a, c, g, or t
  misc_feature (156)..(156): n is a, c, g, or t
  misc_feature (195)..(195): n is a, c, g, or t
  misc_feature (206)..(206): n is a, c, g, or t
  misc_feature (213)..(213): n is a, c, g, or t
  misc_feature (263)..(263): n is a, c, g, or t
  misc_feature (271)..(271): n is a, c, g, or t
  misc_feature (380)..(380): n is a, c, g, or t
  misc_feature (394)..(394): n is a, c, g, or t
  misc_feature (406)..(406): n is a, c, g, or t
  misc_feature (410)..(410): n is a, c, g, or t
  misc_feature (421)..(422): n is a, c, g, or t
  misc_feature (429)..(429): n is a, c, g, or t
  misc_feature (521)..(521): n is a, c, g, or t
  misc_feature (551)..(553): n is a, c, g, or t
  misc_feature (594)..(595): n is a, c, g, or t
  misc_feature (644)..(650): n is a, c, g, or t
  misc_feature (659)..(664): n is a, c, g, or t
  misc_feature (676)..(676): n is a, c, g, or t
  misc_feature (687)..(688): n is a, c, g, or t
  misc_feature (698)..(699): n is a, c, g, or t
  misc_feature (739)..(739): n is a, c, g, or t
  misc_feature (747)..(747): n is a, c, g, or t
  misc_feature (750)..(754): n is a, c, g, or t
  misc_feature (773)..(780): n is a, c, g, or t
  misc_feature (787)..(790): n is a, c, g, or t
  misc_feature (1094)..(1203): n is a, c, g, or t
  misc_feature (1274)..(1275): n is a, c, g, or t
  unsure (1)..(1286): unsure at all n locations
ctgcnnnnntaaatcactatggagcaaattaggctgtctccaacagtgccggtaaaatgtcctctaccctaaatatatcatacatatgtgtcctgtaaggctaactgcaacggtgcccccttngaacccctcnccttgcatgccggctgtaggggncactctacggccgcagcggtgccccctacagcgcccccntacgcgtcggnccccttntctcccccccagatatagtgtgtcactattcatccctctaaacactgtgntgtgggtncacgagtaattgttagtagataaaaaattgatagttgatatagaaaatgatattttatagttgtagtggggtatagggggaatatttaggggaaccgctgcgggagatnaaaaaatagggggnaaaatagggggnaaangtgatataggnnaaaaaanttagggataacggttgcggatagcctaagcgtccagcaacaaaccctaaatcatccgctataatatagcggctctctctctccctctattantggcggacacacgacgctcgctatgcactnnncaatcacgcacaccaactccttccattctctcttgcgcttnntcgtcgtcgtcgtcgaagtcgttggagctctcgacgatgctgagctcgnnnnnnncgccgcctnnnnnntccctgtccccncccatggagcnnaagatgtcgnnccatcgccaagctacacgtccgagccatgggtagtacaangcatgcgncgnnnnngagagggagtagacgaggnnnnnnnngaggtcnnnngctggggacgacgttggcaaggtggaccacatgatgcttgtcgccaatggctacaccgagctactagtgttcctcaactacctcagcgtggaaaacgcggacgcctggctggtgctcaaggaaatgtttgagcactatagtctatagacatgaacgatgtaatgcatttttttaaaagaagtcggataaccttttccttatagaaacacgagtagtaatgtaggatacaaaatgtaattattttaattagttcctaattcatttttgctagaaatgatttttattgcgaaatctggcacactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttatagagggtgaattttagaggacgttgctgaagacagcattagagaacagtactgcagatgggnnggcgggggaga

SEQ ID NO: 939 - DNA, 824 bp, Zea mays
  misc_feature (7)..(8): n is a, c, g, or t
  misc_feature (773)..(773): n is a, c, g, or t
  misc_feature (798)..(800): n is a, c, g, or t
  misc_feature (805)..(809): n is a, c, g, or t
  misc_feature (813)..(821): n is a, c, g, or t
  unsure (1)..(824): unsure at all n locations
caccgcnngcgaagccgatgcgagtgaaggtgggtgcgaagaagcgtggtcgccccaagggtagcaagaacaagaagaaattatgaatgccaatgatgaacatgatggttatcatcatagatcacatgaattaactgagatatgcattcaatcacactgccattgtagtcaaccgaagcactcgtctgctggttgaattctcacttgctgttgccaggatctctaatgtggagcaagcaattttattgctgaaagacttctttttcaatggtagaattcttccttttcgagattatgatgttaatctctggttcgtccccactgccgtacttgacattatgctttagctgtaactattgtatttgcatattcgtctaatttctgcttccctgaagacagttgtattgatctaaatcgataggtgtctagttactgtttattgtacgtttgagtttggtgctactctgctctagtgctctgtgtcgtaatgctgcaataaatggaatggtttaaagctctaattttaacgcgaattttgcttatgacactttccgtaccagaattttgcaccttggctgtccttattgcaatgtcgtgtgatcaaaatctatttcctttttaagttttttagcagctattagtttcactcatcgagatgcttgttctgctcttgtttattagtttacttgttcaagaaaatcgtatcgaactgggaactgttataaaagtctaaatgtgcacgctcttatcatgattatatcttctccgtcaanccttttctttatttcttttttgctnnnttgannnnntctnnnnnnnnnagt

SEQ ID NO: 940 - DNA, 947 bp, Zea mays
  misc_feature (7)..(16): n is a, c, g, or t
  misc_feature (20)..(39): n is a, c, g, or t
  misc_feature (43)..(43): n is a, c, g, or t
  misc_feature (51)..(51): n is a, c, g, or t
  misc_feature (82)..(87): n is a, c, g, or t
  misc_feature (90)..(93): n is a, c, g, or t
  misc_feature (139)..(139): n is a, c, g, or t
  misc_feature (566)..(572): n is a, c, g, or t
  misc_feature (871)..(873): n is a, c, g, or t
  misc_feature (902)..(904): n is a, c, g, or t
  unsure (1)..(947): unsure at all n locations
tattgannnnnnnnnntttnnnnnnnnnnnnnnnnnnnnttantgtgtccntaagtgttattcttacaattgccatcttttnnnnnntgnnnngtactaagtattagccatattttactgtatgaaattcttggtttantttttttccgcttaaacgattatattactgagatctttgttgttggtagaatgatgtcacttggcatgaaaatcgttgggagaaccaggacagcaaatttttggcatttacgtaaggaagttaccttagcggaagtgctacgttctgtatacatgatgatatttcttatgtatttttactgaatctttgacacttatctgcttcttcatgattctggtgcaggatacatgatcacagttctggtggagacatctatttggcattcaatgctcatgagtattttgtggatgctgtaattcccccaccaccacaccataaatcttggagtcgtgtggtatggatactgtctgattctgctaacatgtttataccgagtaatttgctgtttagtcctaggatgttcaagtgccaggtatcgtcctgtaannnnnnntagcattgtctacagcaattttgttgtattcgttacttgtgtctggctagcttttgtgctgcttctatcttaacttcccttcagttaccttacaatttctatatcgcctccacaggtggataccaacctggaatcaccaaaggatattgtcccagaaggggtgccattcacaggttcagggtacaggattgctccctactcttccatcttgcttaaggcaaagccttagaatggcggaggcaagtcattctcaagtaagcacgaataatggtgttgtgatccctaactttccaagctcnnngccaactgtactgcaagtatagcaaactnnngtatgtgaagtcggaccaacccttgcggaaatcaacggaagcc

SEQ ID NO: 941 - DNA, 761 bp, Zea mays
  misc_feature (230)..(230): n is a, c, g, or t
  misc_feature (458)..(458): n is a, c, g, or t
  misc_feature (615)..(616): n is a, c, g, or t
  misc_feature (633)..(633): n is a, c, g, or t
  misc_feature (649)..(650): n is a, c, g, or t
  misc_feature (659)..(659): n is a, c, g, or t
  misc_feature (661)..(662): n is a, c, g, or t
  misc_feature (664)..(665): n is a, c, g, or t
  misc_feature (675)..(675): n is a, c, g, or t
  misc_feature (681)..(686): n is a, c, g, or t
  misc_feature (688)..(689): n is a, c, g, or t
  misc_feature (691)..(692): n is a, c, g, or t
  misc_feature (695)..(696): n is a, c, g, or t
  misc_feature (698)..(705): n is a, c, g, or t
  misc_feature (708)..(711): n is a, c, g, or t
  misc_feature (714)..(722): n is a, c, g, or t
  misc_feature (724)..(724): n is a, c, g, or t
  misc_feature (728)..(729): n is a, c, g, or t
  misc_feature (733)..(733): n is a, c, g, or t
  misc_feature (736)..(740): n is a, c, g, or t
  misc_feature (742)..(760): n is a, c, g, or t
  unsure (1)..(761): unsure at all n locations
cggcctcttccatttctgatcactgtccgttgttactcggattgcatgacttctttatgggtaggagatggtttcatttcgaaagcttttggccctggttggatgggtttgtggaggaggcccagatgtcctggaatcaacatgttgatgctaactgtcccctgaaaaagatttgctgacaagctaagtcgactttctagtgatttgcagtcctggaatcacaaaaaaanctggtcatattaagcagcaaattctgttggctaaagaaatcttgcaccgcttggaaatcgcccaagattccagattgctctccccgcttgagacctggctgcgcaggaagttgaagtgccattcccttggcctcgcttccctggaaagcaccatggcaagaacgaagtcaagattaaggtggctgaaagagggtgatgctaagttgctaacacggtctatttccagcnacacacccggtacaggaagaagaaaaacttcatctcaaagcttcaagttgatgataggttgattctggaccaagaggagaagaaagaggctgtttggggcttttataatgagctgcttggaactgctagacagcgagacttcacccttgacttgctnncctttcactgtccggcntcgaaactgtctgatnnggagctacngnnanntgatgagganatctgnnnnnncnntnntgnntnnnnnnnngannnngcnnnnnnnnncngatnncttnacnnnnnannnnnnnnnnnnnnnnnnnt

SEQ ID NO: 942 - DNA, 761 bp, Zea mays
  misc_feature (46)..(68): n is a, c, g, or t
  misc_feature (101)..(101): n is a, c, g, or t
  misc_feature (132)..(132): n is a, c, g, or t
  misc_feature (137)..(137): n is a, c, g, or t
  misc_feature (170)..(170): n is a, c, g, or t
  misc_feature (182)..(375): n is a, c, g, or t
  misc_feature (396)..(396): n is a, c, g, or t
  misc_feature (402)..(403): n is a, c, g, or t
  misc_feature (412)..(412): n is a, c, g, or t
  misc_feature (486)..(486): n is a, c, g, or t
  misc_feature (523)..(527): n is a, c, g, or t
  misc_feature (548)..(548): n is a, c, g, or t
  misc_feature (588)..(588): n is a, c, g, or t
  misc_feature (591)..(596): n is a, c, g, or t
  misc_feature (600)..(600): n is a, c, g, or t
  misc_feature (684)..(685): n is a, c, g, or t
  misc_feature (691)..(694): n is a, c, g, or t
  misc_feature (700)..(701): n is a, c, g, or t
  misc_feature (707)..(708): n is a, c, g, or t
  misc_feature (713)..(714): n is a, c, g, or t
  misc_feature (717)..(718): n is a, c, g, or t
  misc_feature (728)..(728): n is a, c, g, or t
  misc_feature (736)..(737): n is a, c, g, or t
  misc_feature (739)..(740): n is a, c, g, or t
  misc_feature (745)..(745): n is a, c, g, or t
  misc_feature (747)..(747): n is a, c, g, or t
  misc_feature (759)..(760): n is a, c, g, or t
  unsure (1)..(761): unsure at all n locations
tgcctgcaggggccagctgcggtgcgtgcgcaccagaaaacgcatnnnnnnnnnnnnnnnnnnnnnnntccgtggctccacagggtggagactggagaatngagatcgagcagtggagcttatgtgtatgantgttnagttgatctataagggcatgtataatctagagnttatgaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggatctataactttttnttgttnngttgaaganctagattctataagtctaatgctgacagaagagcagcagctggatagctagttggatagaactgcttttctctntctggggcgtctctatcggcgaaacgatcctcagctnnnnngggaggatgagaaccaagaanggcatatcctgcgagatattatctcgattggtagcactantgnnnnnngggncacatcgccaacttgtgcagatgagggaaaagcttttgccacactggatagcagatagctattctcgatatctggattcacganntgaacnnnnctcacnncgacanntactnntgnntttttttttngcacacannannctcgntntgtacatgctgnnt

SEQ ID NO: 943 - DNA, 377 bp, Zea mays
  misc_feature (30)..(30): n is a, c, g, or t
  misc_feature (291)..(291): n is a, c, g, or t
  misc_feature (338)..(338): n is a, c, g, or t
  unsure (1)..(377): unsure at all n locations
cataatcggctgcatgtcgacatgcgacgncccactgaagaacggctcatgctccggcaccgctggctgctgccaggcggagctcccgccgggcgtccagttttaccaaggcttcttcaactcgctgcacaacaccaccaagatatggaagcaaacaccctgcaactacatcaccgtgatggagagcgcggccttcagcttcagctccacctacctcaactcgacggtgttgtacgactccgacgacgggaggacgccggtcgtgatggagtggggaatcacacggcagangtgcgaagaagccaaagccaacaagactgcgtacgcgtgtgtcagcnaccatagcgactgcgtctacagcgatgccgccggctacc

SEQ ID NO: 944 - DNA, 661 bp, Zea mays
  misc_feature (10)..(13): n is a, c, g, or t
  misc_feature (592)..(594): n is a, c, g, or t
  misc_feature (601)..(602): n is a, c, g, or t
  misc_feature (634)..(636): n is a, c, g, or t
  misc_feature (638)..(641): n is a, c, g, or t
  misc_feature (647)..(660): n is a, c, g, or t
  unsure (1)..(661): unsure at all n locations
tggatggctnnnncattgtagccaccaacctggttcatgcatatgcaggggtgttagagctttgttctgcccgtgccttgtttgatgggatgacgcataggaacacagtcacttggaatgtaatgctcaatggatatgtgaaggcaaagatgatagacatggctgcggaagtgttctggaggatcccagagcgagatgaggtatcttggttgacattgattgatggatatatctgtgcagatctgatatcagacgcaatgaaggcatatgttcaaatggtgggtgaagttggtgcaaacgactacgaggtattgcttgttgatttgatgaaggcgtgtgctcggtactctgctgttacagaaggccaacagctgcatacagttattctgaagaatggttttgatgcccatgcatttgtgcaagcgaccctggtccatttttatgggtgttgtggtcttattggccttgcacagatgacattcagattgtcagacaagtcccacacagcatcatggaacgctctcttggctgctctactgaggaatggcctaattcgtgaagcaagggagctgtttgatgatatgcctgaaannnacactgnntcttggagtacaatgatttctgggtatgtgcnnncnnnncgttcnnnnnnnnnnnnnna

SEQ ID NO: 945 - DNA, 765 bp, Zea mays
  misc_feature (7)..(7): n is a, c, g, or t
  misc_feature (22)..(22): n is a, c, g, or t
  unsure (1)..(765): unsure at all n locations
gcctgcngacatacatgtctgnttttttgctagatccatgatattttggagaacattttggaaaaaaacataatgttccaaccaaaatgcatagcacactcgtcaaagcagttatgttttatgttattttctctatcattaacaatgatctgaaaggaaagatgacagcaataaaaactggaaccaaattgtgttgcaaaagataataagatcagagcaaaaacagcactaacagaaaagcattacttacacatcagcaaatttggtacccccttcacctcttatcctaatctgcctttcccatccatgagggggttgtgcaatattgggtttgtcaatagcccaaagcctgctaccgtcctgagatatatcttctgggtcattgcatgttatatcaggtctccattcacgagctcttttgcatacaaaaggttcctgtataatacgttcacgaatttcttcgtatttctcttttgttggaataagcctccatttaaaacatttagcacattggacagtgaatgctccaatagatggtgatatcccctttgttatcactgacttctgcaaacggttttctcccagttcatctgctgcttcagagttgaacacaaccatttgatttgatgcagtttctgaacaaaaaccgtcattgtcaaatcgggagcgattgctatcagaaggcaccacaatccgactgttttttgatgactgaggagatttagaactttccatcgattttgtaaaaatattagagcctgagta

SEQ ID NO: 946 - DNA, 375 bp, Zea mays
agcaaaccaggttttggatgagatggttttcaagggttttgcgccaagcaacgatggtgcacagaagtttgtccaggggattgagaaggaaggagatgtggtattgctagagtcagtgttgtgccgactagcgaaggtgaatgctttggtgccaagtggatgggaaaaagctgtaagtggtgcgctgaatgatcccacagagttgaggctagagaagcagcttgactctttaagaattgcttgattagacaccatagtggatttgatcaatacagtttgagtagcaaaaaaatggcaagcatgatttttaaagaaatcaatttgttcatctgttatacaaggctgccttgcaggagtcttacccaattcaggtta

SEQ ID NO: 947 - DNA, 688 bp, Zea mays
  misc_feature (35)..(35): n is a, c, g, or t
  misc_feature (67)..(67): n is a, c, g, or t
  misc_feature (78)..(81): n is a, c, g, or t
  misc_feature (147)..(147): n is a, c, g, or t
  misc_feature (151)..(151): n is a, c, g, or t
  misc_feature (319)..(319): n is a, c, g, or t
  misc_feature (346)..(346): n is a, c, g, or t
  misc_feature (404)..(404): n is a, c, g, or t
  misc_feature (597)..(603): n is a, c, g, or t
  misc_feature (625)..(627): n is a, c, g, or t
  misc_feature (631)..(632): n is a, c, g, or t
  misc_feature (641)..(642): n is a, c, g, or t
  misc_feature (644)..(644): n is a, c, g, or t
  misc_feature (646)..(646): n is a, c, g, or t
  misc_feature (648)..(653): n is a, c, g, or t
  misc_feature (655)..(655): n is a, c, g, or t
  misc_feature (660)..(660): n is a, c, g, or t
  misc_feature (664)..(669): n is a, c, g, or t
  misc_feature (673)..(675): n is a, c, g, or t
  misc_feature (677)..(677): n is a, c, g, or t
  misc_feature (679)..(680): n is a, c, g, or t
  misc_feature (685)..(687): n is a, c, g, or t
  unsure (1)..(688): unsure at all n locations
tgtttataaaaattgacttttatctcattgacttntgcaaatctctatgatcatgaaggatctgttncccacattttnnnnccctaggaacatgtagtgtgaaaacagtaacactgagtccctgatttccttttgctcagatagctnatanatttacttggctgatctggtctagattaaaacctaccatgtttgtctttcttggttttacagacaaattcttgatttctgagagttggcaattttctacaatcttaccatgttgttgcgtctaaatcaaagaactggcaatcctatatctagtgacaagatatgatgntccttgtctgctcatccaggaaccttnaccagaccaattaggctatgtaatttctgatatttgagttagtatgcagtgttgaagngcaaactattgcacagttgttatttaatcttatttttcaaagcgtgtatattctgttctttcagaaaaaagagatcatattagttcaattttggtctttgcagatgtcttgaaggagctgttacatgccttcccctcactagcaatgacaacaaattctgtaaatgccacagctttggacactgctgcaactnnnnnnnacattgacattgttaatcttcnnntagnnacagatgcnngncntnnnnnnantgcanaaannnnnngaannncngnnttgcnnnc

SEQ ID NO: 948 - DNA, 961 bp, Zea mays
accaacaacttcaacgagagcaacaagctcggggagggcggattcggcaccgtctactggggccgcacctccaagggcgtcgaggtgcatgcatgcactacatatctgttcatggtcttgtcagtttaattacatgtcgtaagctcgtgattaagattcgtgacaaatgtgtgcggtacggtgttcagatcgcggtgaaacgactgaaggcgatgacggccaaggcggagatggagttcgccatcgaggtggagatcctcggccgcgtccggcacaagaaccttctcagcctccgcggcttctacgccggcggcgacgagcgcctcatcgtctatgactacatgcccaaccacagcctgctcacgcatctccacacccagcgcggcgccccctcctcccagcagcatcagcccctcgactgggcacgccgcgttgccatagccatcggtgccgccgagggcctcgcgtgagtcatcatgcatgcgcgcgcacacacaccgacaccgtgcaagtgcaatcaaagactttccttaagaatccgtgtcttcgttcatttcagctacctgcaccacgaggccaacccgcacatcatacaccgggacatcaaggcgagcaacgtgctgctggacgcggagttcgtccccaaggtcgccgacttcgggttcgccaagctcatacccgacggcgtgtcgcacctgacgacgcgggtgaagggcacgctgggctacctggcgccggagtacgccatgtgggggaaggtctccgagagctgcgacgtctacagcttcggcgtgctcctcctggagctcgtcagcgcgcgccgcccgctcgagaagctccccggcggcgtcaagcgcgagatcgtgcagtgggcggcgccgctggtggaccgccgcaagtgggagcgccttgcggacccgcgccttgccggacgcttcgacttgctgcaggcatgcaagat

SEQ ID NO: 949 - DNA, 475 bp, Zea mays
  misc_feature (442)..(442): n is a, c, g, or t
  misc_feature (446)..(446): n is a, c, g, or t
  unsure (1)..(475): unsure at all n locations
ggaaccacccatctccttttaagctcttcaaataccgggcagccattattccaccaggaagcaagattccccaggcaacaaacatcataaacccatgaacagccaggacaggacgcaaatcctgttctgcctcagctgaacctctcaacaacaaaacacgtataggccgactgcttgtgactgaatgcatgttactgtctgtcagatcatctcccgaccagcttgcacccatggcccagacaaccttaagtggtgtagttggatcgatgatgttcttgcattctacttttccggtacaagaagggttaagagggcgagtaaattcaaatgtaataatgccattttctgacttacaccgaacaaaagtgatgttctcagatgttgggtgaatgcctgttgcactctttccatcaatccaataagtttttactcgcccaacccnatcnttgcccacccaagcaacataggtgaagct

SEQ ID NO: 950 - DNA, 1312 bp, Zea mays
  misc_feature (2)..(6): n is a, c, g, or t
  misc_feature (15)..(20): n is a, c, g, or t
  misc_feature (338)..(338): n is a, c, g, or t
  misc_feature (344)..(344): n is a, c, g, or t
  misc_feature (481)..(481): n is a, c, g, or t
  misc_feature (507)..(508): n is a, c, g, or t
  misc_feature (538)..(538): n is a, c, g, or t
  misc_feature (541)..(542): n is a, c, g, or t
  misc_feature (599)..(599): n is a, c, g, or t
  misc_feature (617)..(617): n is a, c, g, or t
  misc_feature (784)..(784): n is a, c, g, or t
  misc_feature (808)..(808): n is a, c, g, or t
  misc_feature (811)..(811): n is a, c, g, or t
  misc_feature (862)..(862): n is a, c, g, or t
  misc_feature (869)..(869): n is a, c, g, or t
  misc_feature (878)..(878): n is a, c, g, or t
  misc_feature (889)..(889): n is a, c, g, or t
  misc_feature (947)..(947): n is a, c, g, or t
  misc_feature (975)..(975): n is a, c, g, or t
  misc_feature (984)..(984): n is a, c, g, or t
  misc_feature (1032)..(1032): n is a, c, g, or t
  misc_feature (1097)..(1097): n is a, c, g, or t
  misc_feature (1130)..(1130): n is a, c, g, or t
  misc_feature (1141)..(1141): n is a, c, g, or t
  misc_feature (1189)..(1189): n is a, c, g, or t
  misc_feature (1212)..(1212): n is a, c, g, or t
  misc_feature (1236)..(1236): n is a, c, g, or t
  misc_feature (1261)..(1262): n is a, c, g, or t
  misc_feature (1270)..(1270): n is a, c, g, or t
  misc_feature (1299)..(1300): n is a, c, g, or t
  misc_feature (1305)..(1311): n is a, c, g, or t
  unsure (1)..(1312): unsure at all n locations
gnnnnntgtgactannnnnngactacggccgcctcgtcgtcatcgtcgatgtggtcgaccagaacagggtatgtactgagctctctcataaatgcgtgtcgttctgttcgctgttgtgatttcgatctagagctttagaggaatgcttttgatatagtgtttggttccggagtatggtgggacggctcctaatttgttgttgtttggattggttccatgtagtacagagtggttccaaaaaaggaaaattatgctcaaatgtcgaaccatcccgctctctcggacggagccgctccctggaatgtagcctttctatcccaattggctccggaaccaancactantgttagttggttggtatccgctgctcttcgtgagaattatgaaaacgttatatgcctgtatttggcatcacctgatgcaatttatttgaattggcaaagtagcgtggcgttgtccgcatctagcgtttattaatacntactcttaagatcaatggatgactannagtgccctagcatttggcagtgccaggagnatnngggttgcttgccaaacttgttcccttaatgaaccaatgactaattctcttgtttagnttccttttaaggcacaangaatgttcgatatttaacaatatatatttgtggagcctgtgcctcagtaattgatttggttaggcattcaagcactcatggccttgatgcattctatggaccaggcacttgtggacgcccctgatatggtcaggtgccagattaacttcaaacggctctcacttacngacatcaagattgacatcaaacgngtncccaagaagtcaaccctgatcaaggctatggaggaagctggtaatgatgancctcatntagtggacntcttcagcaangttgtgctttattcatctatattctagatgaagataatagtgacaattaattgatgcnttgttattcttttttagatgtgaagacnaagtggganaacagctcatggggcaagaagctgattgtccagaagaggagggctgcnctcagtgactttgacaggttcaaggtcatgctggcaaggatcaaggtcaggaacctccctgtcanatgtctagttcctgttggcactgagtatattgnttgctcacacntttttcctttatgtaaacagaggggtggtgctatcaggcaagagctcnccaagctgaagaaggcgtccacngcttaagtcccttttggtggatgncatgttagtttttggtttcatgttnnatcagcantttgttttgagtgttgtcaaagccagaannagtannnnnnnc

SEQ ID NO: 951 - DNA, 583 bp, Zea mays
  misc_feature (246)..(246): n is a, c, g, or t
  misc_feature (281)..(281): n is a, c, g, or t
  misc_feature (291)..(291): n is a, c, g, or t
  misc_feature (391)..(391): n is a, c, g, or t
  misc_feature (418)..(425): n is a, c, g, or t
  unsure (1)..(583): unsure at all n locations
catgcctgcagttacaggagtactccaaaagcacagaacgagcacagcataaattatgacctatttgatgaacaagattagtattaataaggtatagcacatggcaaaacaagaaaaccagacatagaaggtagttcacataggagcaccttagtaaccaacaaaaattttgtgtatttgtcgtataaggattgcttccctttaaggtcatgttcctgcactgtaaagcaggcaaaggaaaaaaangttatgaaggttaaaatgcatcatgggagcatcanctcattttgnacaaataacaaagaagctaaattttgctcccgaacaaacaacagcaatgctacggaatgcaactacctagcatttccaaaaatacagggccttccggtantgtattacaacttacaagcgatgaggnnnnnnnnccaagacgattagacgaatagctacagaacaagacaatgagagttcagcactcactttttgccagttccttctccttggcagcagccaggcgcttgagtttagcagcttgtgcaaatgtggacggcctacagcagacatacaggcaaagaagcgagga

SEQ ID NO: 952 - DNA, 463 bp, Zea mays
  misc_feature (31)..(31): n is a, c, g, or t
  misc_feature (83)..(83): n is a, c, g, or t
  misc_feature (93)..(98): n is a, c, g, or t
  misc_feature (103)..(103): n is a, c, g, or t
  misc_feature (111)..(111): n is a, c, g, or t
  misc_feature (126)..(127): n is a, c, g, or t
  misc_feature (160)..(160): n is a, c, g, or t
  misc_feature (171)..(176): n is a, c, g, or t
  misc_feature (256)..(256): n is a, c, g, or t
  misc_feature (284)..(284): n is a, c, g, or t
  misc_feature (310)..(310): n is a, c, g, or t
  misc_feature (342)..(342): n is a, c, g, or t
  unsure (1)..(463): unsure at all n locations
tcgagcgacaccgccagcgacacggtgctgngtcgagccgagcacgtgcctggtcgatgggcagcagctcgctgacacaaagnaacgtcaaannnnnncccancgtccggnacctccgttgcatcnncgccggcagacagcctgctccttggcagcgccncggaggagggnnnnnntgagtgcgcgatcgggcgcgcgccgtcgtcccaccaggctggcgcagagggagcatttagaccgccggcatctgacgcgngcggggacgatgactcggaggccggagnccgccggaacactcgcgccgtggaancgggacggaggggacgggcagcggcctatcgntgtcgacgcgggagaactggcggagcgagaaggggtcgacggccacgtccctcacccagtcaccctcgtatcttccggaaggcctcttcccacgtccctctgcatggctgagcgcgtacgc

SEQ ID NO: 953 - DNA, 1043 bp, Zea mays
  misc_feature (54)..(54): n is a, c, g, or t
  misc_feature (71)..(71): n is a, c, g, or t
  misc_feature (86)..(86): n is a, c, g, or t
  misc_feature (94)..(94): n is a, c, g, or t
  misc_feature (124)..(124): n is a, c, g, or t
  misc_feature (134)..(134): n is a, c, g, or t
  misc_feature (158)..(162): n is a, c, g, or t
  misc_feature (180)..(181): n is a, c, g, or t
  misc_feature (234)..(236): n is a, c, g, or t
  misc_feature (320)..(320): n is a, c, g, or t
  unsure (1)..(1043): unsure at all n locations
cgttcacagtccggtctctttcgttgttccatttcttttgttgagaaaatcggncttgcactctagctctncacagagagacacgntattgggnacagagctagtagggagtgagcacatgtanaacctttttnggtacaaagagaggagcaaccaannnnnccacttcatgctccacgnngccgggctcaccaccggcctccttccatagcgggagagcgttgcttaaattannnaatgctttgcgttgaccccttcggtcccatttgtactcacatggttggcacagagattcaaatgcctcccacctcccacgttgntgcacagtgttttgcccatcagaatatttcatgacacttcctaagacagatcacgcggcgtgcatgtttttgtcaaaaacttatcccaattcccatcccaaccatgtggcatgctcgctcccattatacccacatagttggcacggagattcaccgactcccacgtcccacgttatcgcacaatgatttgcccattttagaatatttcataacacgtacatactctccctaatacaaatcgcgttacgtgcttgttttgtcaaaaaaaaaacttatcctaaaaccatgtggcaacaaggcaggagaaaaagaatgttatattgcacgcatgtgctacgtcgtgcctgttgttttgataaaaaaaatggtgtctccctaaccaccttgtgtgagaaaacgcaatagaaaaagctcaccgagaaaaaaaaaatgtagaacaattttgatcattcttcagcacatatttgtaggctttaggtctttagaacatattggtcttcaagcccataattatggaatacatggagttaaggggtttttctctccctgcatcatgtagctttctaattaagttgtcttatgccaattcctcgaatgtatttgtggaacctagagactaccatagaatttgccagcaaatttgctgcggacacaaactttgctgcgaacacaatatcaggtcttgtgtagttcgtcaggtatattagtgcttcaatggttctc

SEQ ID NO: 954 - DNA, 1072 bp, Zea mays
  misc_feature (530)..(530): n is a, c, g, or t
  unsure (1)..(1072): unsure at all n locations
gagatttttctgatagatcagagggcacaggaactgtccgagttgtttcaaggcctcctcaaatcgcctccacgaaggatggtagatctgatatgcctcaaagtccaaaagcaccaatacgcacagctgatcgagaaaatcagtggaggtcatcagggactggatctgaagaatctctctctctcagagatactcagagcggacgagggagagtagaaagttctactgatgacgtaatattttggcttttggcatgcaatttggttaaatcatgatgatttcactaactataagtttttaccagaatgatcactctgtaagtgggtcaggaactgttgtgttacgctctccaagagcatctcagttgtactcaacagctagcaaccacagtgccaaggtaagttacaaacactacttatacatttttaagattaacatccttactgtctatgtaaaacatggcaaagatagaactgaggagcagcagctaacacatctttacttcttagcctcccagcagattctcctcntatgaagatatgtctaatagtgggacagttgttcggacccaaaatgaagacccagaaactccacgatcttcaaggtcaaggctggggatccaagaaaaaacatcaaatgctcctcttgaggatagtgccattaaccttgcagaggtgatgcacattaacaatttgttggcagttttttgtttgtggttattagtcgatgcataattataatgtacatggtggtacatgcaggcaaaggctgctttgcaggctgggttaagaaagggaaatgctcgagaaagaccttttatcaacaggcatgaaaagggatcacatgagcatagatcttctggagtaaatagtcaagaggttcaaaggtatttcaagcttacctttacctgtgtttaatttcattgatagaaacactttgcccttattattaaagtttttttaaaccaaagtgtgttctttatcctagcgaggatgtggacacgcagaaaggtcacaaattacggcaattacctgatgggcagtcagcctctcgtgctagttctgtagcttca

SEQ ID NO: 955 - DNA, 1610 bp, Zea mays
  misc_feature (60)..(60): n is a, c, g, or t
  misc_feature (72)..(72): n is a, c, g, or t
  misc_feature (78)..(78): n is a, c, g, or t
  misc_feature (101)..(101): n is a, c, g, or t
  misc_feature (300)..(320): n is a, c, g, or t
  unsure (1)..(1610): unsure at all n locations
tctctcctgtccccacttgacacagccaggtcccaatctccgccggccgcaggtcaaccncctctacccaanatccantctccgttctccctctcctctcncttcatacacaccagggcggcatctgcatcgggtgtatggcttatttgcgcttagtttgctttatttctatggattgtttcaaaaaagaaaactatggagattgcatacagttcacgacagatcaagaggatcatcgatgtcctgctgcgctggtcatttgttgcatctgttgctggtgatgcaatatatgaattttannnnnnnnnnnnnnnnnnnnncaggggcccgccatcaccaacccacctcccttcaattataaacctataaaatatcatcattgacccaagctgaggcgactagtgggtattgatttttggtggggcagatcaaggagggggggagggggttaacttccaaggaaccagttcattgctggttctgctagcaggaggttggatttcagaggcagaagctttcagccaggcgggctcagggcgcgggcacatcaatggctggcaaggaaatcctccacaaggtgaaggacaaggtgaaagatgcatttagttcatcaggaccagaaacagggaaaggcaagacaaagttatcaggcaagcgtgtcaagcatggttaccatctggtgaagggcaaatctaatcatccaatggaggattatctagtggcagagtaccggcaagttggtgaacatgatttgggattgtttgctatattcgatggtcacctgggccacactgttccagactttttgagctcccatcttttcaataacatcttgagtgagccagaattcttgagtgatccagaaactgctatccgaaacgcataccaacttacggatcagaagatattggaaaacacagcagagttgggaagaggtggctccacagctgttactgccatcttaataggaagtgacaagttcgtgaaactagttgttgcaaatgttggggattcacgggcagttattagcaagaacggtgtagcgaagcagctttcagttgaccatgaaccaaacatggagcgacaaacgatcgagcagaagggtggctttgtatcaaacctaccgggtgatgtgccacgtgttgatgggcagctggcagttgcaagggcatttggagaccggagcttgaagaagcacctcagctctgatccatatgtggtcgagcaaactatcgatgaaaatactgagtttttaattctagcaagtgatggcttgtggaaggtgatgtccaaccaggaggctgtcgacgagatcaaggattgcaaggacgcgcaggcagctgccaagcacctgacggagcaggccgtgaaccggaagagcaaagacgacatttcagttatcgtagtcaagttcatgtgctagcacatcgtcaggttaaatggtctcccgattgtataccgtgttaaattatcttttaagtcttgtgctcgctggtgtcggacattttgtttaccttctttggttttgggaccccacaaagagggtcaaggcttgtaacatattgttgtttgtttaaggctccaaataaagcatggtaccaccatagtaa

SEQ ID NO: 956 - DNA, 754 bp, Zea mays
  misc_feature (99)..(99): n is a, c, g, or t
  misc_feature (123)..(123): n is a, c, g, or t
  misc_feature (225)..(225): n is a, c, g, or t
  misc_feature (304)..(304): n is a, c, g, or t
  misc_feature (366)..(366): n is a, c, g, or t
  misc_feature (393)..(393): n is a, c, g, or t
  misc_feature (477)..(477): n is a, c, g, or t
  misc_feature (481)..(481): n is a, c, g, or t
  misc_feature (532)..(534): n is a, c, g, or t
  misc_feature (550)..(550): n is a, c, g, or t
  misc_feature (561)..(562): n is a, c, g, or t
  misc_feature (639)..(640): n is a, c, g, or t
  misc_feature (649)..(651): n is a, c, g, or t
  misc_feature (664)..(667): n is a, c, g, or t
  misc_feature (675)..(676): n is a, c, g, or t
  misc_feature (685)..(689): n is a, c, g, or t
  misc_feature (705)..(706): n is a, c, g, or t
  misc_feature (715)..(720): n is a, c, g, or t
  misc_feature (724)..(733): n is a, c, g, or t
  misc_feature (737)..(748): n is a, c, g, or t
  misc_feature (751)..(752): n is a, c, g, or t
  unsure (1)..(754): unsure at all n locations
catgcctgcagttgcagtttgtttaaactcatattatctgttttaggtagtaaagtgaattttcactaaatgacaatgcagtggcctgagttcagggtnaatctcccaggggttggtgatgtnaacatcaatgcggcattctttaggaagtttgactatagtaattcaatggttagtacaatttgaacctcaaagttgcttcaaacttacatgtggtgctgaacngctagtttcctgttttctctctcaactaagctgacatgaaatgaataaccaaacagaatattggtcacatgcaatgaanttagcgcttctatcaaaatgtcatttggtgttatagcaaatgtatgcttagcttgataaacnatggcaacatggcagtttattaatcangtgtttaaaggcactgaatttgttatcatgttcattaattgacgaactgcttgaccactgagcagcaaggtccttatcatgccnaatnaaataaatattctgttatttagtgcatcatttggccatgatacaacaacannntcaaagccttttagtncgccatttggnngtgtataatacaaaatattcatttagaggaagacatttcatgttgattcataaaaaacatgttacatattttctatnnattttggtnnnccacttaccttgnnnncacacatnnaacccatcnnnnntcgctagtttattgannagtcagtcnnnnnngatnnnnnnnnnncacnnnnnnnnnnnnttnnat

SEQ ID NO: 957 - DNA, 684 bp, Zea mays
  misc_feature (44)..(45): n is a, c, g, or t
  misc_feature (65)..(65): n is a, c, g, or t
  misc_feature (143)..(143): n is a, c, g, or t
  misc_feature (386)..(386): n is a, c, g, or t
  misc_feature (407)..(407): n is a, c, g, or t
  misc_feature (433)..(433): n is a, c, g, or t
  misc_feature (472)..(472): n is a, c, g, or t
  misc_feature (521)..(521): n is a, c, g, or t
  misc_feature (532)..(533): n is a, c, g, or t
  misc_feature (604)..(605): n is a, c, g, or t
  misc_feature (614)..(615): n is a, c, g, or t
  misc_feature (631)..(635): n is a, c, g, or t
  misc_feature (637)..(637): n is a, c, g, or t
  misc_feature (642)..(643): n is a, c, g, or t
  misc_feature (647)..(649): n is a, c, g, or t
  misc_feature (652)..(652): n is a, c, g, or t
  misc_feature (656)..(656): n is a, c, g, or t
  misc_feature (664)..(664): n is a, c, g, or t
  misc_feature (666)..(666): n is a, c, g, or t
  misc_feature (668)..(668): n is a, c, g, or t
  misc_feature (670)..(670): n is a, c, g, or t
  misc_feature (674)..(675): n is a, c, g, or t
  misc_feature (677)..(678): n is a, c, g, or t
  unsure (1)..(684): unsure at all n locations
tgtttgatgccttaggcacttaattaaaggtcctgaacactttnncagtctttcaatcatggctntacgttatgctattctgtaagtggtaaaaaacacacggttgcatggtgtatgtataatggaccgacgattgcaatatngcagcccactggtggtctaacgatcatgtaattttattcaaataaaatcataggttttcaggtaattagaggaaaagagagcataccaacgacctacatgatccgctttccacctggaccaatatttcttcaagaagtctctctcaacattcttttgaggacttggaatgcaactaccagctgcataaccctaatatgaatatgaaacagagataatagttggaaaataagatactccttccnttctgcctatttttttccgtncactttcattcaaatgataatgaatntagacatacatggaaactacattcatatgttacttaaanaatatgtgattagtctaaaacgaattatattttgggacggagggagtanatgatatacanntaaatatgattagtaaaaattaataccgtgtatctagcaagcattgattggagtgaaaaattaatgtctgnncgtaaaatnntcatgaatcatgatgnnnnnanatatnnatcnnnaantacnacctactngntntnaaanngnngtatac

SEQ ID NO: 958 - DNA, 424 bp, Zea mays
ccgccctagtcccaaacacaccgaagagaagtgagtttgctccctcattccttcccccatttcccgagttgtgtagttccaaagtttctaaagcggtttccaatcttcaggcaacgcatattcgccgaatctgtcttgaggagactagaggagaaatgaagagacatcaaacactacaagcgcatttggttagtggtttaccgttcagctaccttgtaattcggttggctccccgaaaaaaaaaagtccgggacacgtcaagtgcccagctcagttttgttgtaaatttgttagaaatttgacagaattggtagtgtgaacttaccaagaaaggaagaatagccgcatgtgttgtggctgttcattctatgattggttaggaattgacacttgaaacacggtactctattcagaggctgtgtcc

SEQ ID NO: 959 - DNA, 685 bp, Zea mays
  misc_feature (10)..(13): n is a, c, g, or t
  misc_feature (38)..(38): n is a, c, g, or t
  misc_feature (161)..(161): n is a, c, g, or t
  misc_feature (201)..(201): n is a, c, g, or t
  misc_feature (224)..(224): n is a, c, g, or t
  misc_feature (514)..(514): n is a, c, g, or t
  misc_feature (538)..(538): n is a, c, g, or t
  misc_feature (563)..(563): n is a, c, g, or t
  unsure (1)..(685): unsure at all n locations
acacatgctnnnnaggcatcgtgctagcatgaacttcncttgtgctgagatgagggacagtgaacagagttcagaggcgaaaagtgcacctgaggaactggttcaacaggtttaagccattgtcacttgtctgtattctccttttaaggaacacaaaaggnacttttcaatcattaacaaaatattctggtgcaaactatnaaaaatggcaggtgctgagtgcnggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggtgagtaacacccttgaaaatctagacattcataattggacacatttatgtttgagctacangctgacagaatatatataaaaaantcaggattataatccaaatgtcganccagttgcaccattggaaagatcaaaggcagagataccaattgaagaaatcctagaagtagcacagccaaaattggagccatttcccttcgacaaggacaccgacctaccagtttaaacact

SEQ ID NO: 960 - DNA, 685 bp, Zea mays
  misc_feature (47)..(47): n is a, c, g, or t
  misc_feature (356)..(362): n is a, c, g, or t
  misc_feature (377)..(378): n is a, c, g, or t
  misc_feature (406)..(406): n is a, c, g, or t
  misc_feature (432)..(442): n is a, c, g, or t
  misc_feature (489)..(489): n is a, c, g, or t
  misc_feature (520)..(520): n is a, c, g, or t
  misc_feature (530)..(536): n is a, c, g, or t
  misc_feature (590)..(590): n is a, c, g, or t
  misc_feature (600)..(603): n is a, c, g, or t
  misc_feature (606)..(609): n is a, c, g, or t
  misc_feature (630)..(631): n is a, c, g, or t
  misc_feature (633)..(634): n is a, c, g, or t
  misc_feature (636)..(637): n is a, c, g, or t
  misc_feature (644)..(646): n is a, c, g, or t
  misc_feature (648)..(650): n is a, c, g, or t
  misc_feature (653)..(656): n is a, c, g, or t
  misc_feature (658)..(660): n is a, c, g, or t
  misc_feature (662)..(664): n is a, c, g, or t
  misc_feature (669)..(670): n is a, c, g, or t
  misc_feature (681)..(683): n is a, c, g, or t
  unsure (1)..(685): unsure at all n locations
tgggccttgcagggtaacctctctgctcacattcttccttttttgcngtgctagtaggtccacggtccaccaggtttctgtcggacgctcagatcgtaacagatagcattggatatttgtgacagatttctacattttgcggaaggatgttgagttggctcttgagcgtgtcaatgaagtcaggcagtctgccggtttgcaacagctcgaggaggatatcgcttcgcttgagaacaagtccagtgatagttccttatgggatgatccttccaaggcacaggggatacttgtttctctgacagaggtcaaagacaaagtgaagcttctcaacgatttcaagttacaggtctgagcannnnnnnctcatggcattgccnntgaactgaatgtactatttcacagtttntatgataacaacatggcatatttgcnnnnnnnnnnnacagcttgtggtagctaattaacaacaacaacaaaaagaatctactncaaatattcttgcaacagtttggaattatanatgctatcgnnnnnnnaggaagaagagtgacatatgtcaacaatttggcatgagagctactgcactactngttcttagtnnnnctnnnncttttctacttgtagattgannanncnnagactannntnnngcnnnnannngnnntagannctatagatacnnntc

SEQ ID NO: 961 - DNA, 919 bp, Zea mays
  misc_feature (3)..(4): n is a, c, g, or t
  misc_feature (10)..(13): n is a, c, g, or t
  misc_feature (84)..(84): n is a, c, g, or t
  misc_feature (110)..(110): n is a, c, g, or t
  misc_feature (146)..(146): n is a, c, g, or t
  misc_feature (157)..(157): n is a, c, g, or t
  misc_feature (177)..(178): n is a, c, g, or t
  misc_feature (222)..(222): n is a, c, g, or t
  misc_feature (238)..(265): n is a, c, g, or t
  misc_feature (269)..(269): n is a, c, g, or t
  misc_feature (337)..(337): n is a, c, g, or t
  misc_feature (448)..(448): n is a, c, g, or t
  misc_feature (462)..(483): n is a, c, g, or t
  misc_feature (538)..(539): n is a, c, g, or t
  misc_feature (561)..(561): n is a, c, g, or t
  misc_feature (572)..(573): n is a, c, g, or t
  misc_feature (754)..(754): n is a, c, g, or t
  misc_feature (897)..(897): n is a, c, g, or t
  misc_feature (899)..(899): n is a, c, g, or t
  unsure (1)..(919): unsure at all n locations
gcnnctgagnnnntggtctggaccgttgcataaagataacctacgcctagcgcacaattaactgctccggctgatcaaaacctntacatatgcaatccaataggagtaanaaacctaccgatcaccagaccgtcattctgccatcngttgcttactnatcgtgtactatgccagatnngctgctttgttttggtctcctgccatcctcgtgcgtcgcgcgcncggccttcctctaccnnnnnnnnnnnnnnnnnnnnnnnnnnnncctnggaaatgtgaaacccggccggccttcgcagccccttcgtttccacaccactttactccttaaccctangtcgcgccagccatggcaatcagctaactagagtgtccattcaaagcaaaaccacacggtactaatagtaatcaaccgcacgccccctcgcgcgcgcccacacagtccacntacgtgatatacannnnnnnnnnnnnnnnnnnnnntagacggccatctgatcaaccttctcgagctcttctcacatctcccgctcatttnnaccacaagctagccaagagggntcgctcgctannttagctatatccggccgccgacattatactgacgatggcccacgccgccgcggcagcgctcgcccttctcgtcttcttctgcgcgcaagcgcgggacgcggccgtccatgtcgtcgacgcggcggcgacgctgtcgcaggggcagtcgctgggcgccaccgacaagctggtgtcggccggnggcaccttcgagctggccttcttcacgccgacggggggcgacccgtcgcggcggtacctgggcgtcatgtacgcgcagtccaccgagcagaccgtgccgtgggtggccaaccgcgacgcgcccgtcagcgcggcctccgcgtncncggcgaccgtcacggccgcc

SEQ ID NO: 962 - DNA, 692 bp, Zea mays
  misc_feature (2)..(3): n is a, c, g, or t
  misc_feature (180)..(180): n is a, c, g, or t
  misc_feature (557)..(558): n is a, c, g, or t
  misc_feature (590)..(590): n is a, c, g, or t
  misc_feature (633)..(634): n is a, c, g, or t
  misc_feature (638)..(640): n is a, c, g, or t
  misc_feature (648)..(649): n is a, c, g, or t
  misc_feature (651)..(651): n is a, c, g, or t
  misc_feature (659)..(660): n is a, c, g, or t
  misc_feature (667)..(667): n is a, c, g, or t
  misc_feature (669)..(672): n is a, c, g, or t
  misc_feature (679)..(684): n is a, c, g, or t
  misc_feature (686)..(691): n is a, c, g, or t
  unsure (1)..(692): unsure at all n locations
cnncccccgacgaccgccttgccgatcgccgccccgatcgcgccgacgttcacggcgatcaccgctattgtggggatcagcagtggcgtccactgcaccacgtacatctcagcgtacttctcgttcacggcgctcgtagcctgcttcgccgtcagcttgaacgaaacgccgttcccgcgnaggactagcttcagcacgatgtgcagcgtcgctaacgggtacacggctgtcgccccgatgatgtagaactgctcgttgcggatccagtccagcagcgtgaggcctgcccacttgatctccaccatgccgatcagctctgtcattgctatgatgacgacgaggtacagcacgtatgtcgggaacggcttctggatgtagaactcgccacggaagatccatatgacggggaagaggaggtagaacacaaggaagaccgatgagattgggtaggctgtcatgttggtgtaggcgatccgttgcatcaagttcagtcgacggccagcaaggagcgggcagtgtgagaagaacatttcaagggagccgcccgaccagcgcannatctggcagaggcgctccgtgaggttgattgntgcagtgccacggaaggcatccggctccatgcggcagtacatnnatcnnnaccctgtnngntgtactcnnaagccgntnnnnacgtccnnnnnngnnnnnnt

SEQ ID NO: 963 - DNA, 551 bp, Zea mays
  misc_feature (16)..(20): n is a, c, g, or t
  misc_feature (218)..(218): n is a, c, g, or t
  misc_feature (444)..(444): n is a, c, g, or t
  unsure (1)..(551): unsure at all n locations
catctatctcttcttnnnnntagttattgaatgacaactttatcttctttacattacatttatgtgaattgatttgtcatttttgttcttgactgttatacatgaatgcattcatactgattttatgtattttccaaggaatacctacaataacctgttttctgtggtggatgcttttgcgtgcgttagaagtgtcgagttggctacaataaggtganctaatcaaatatttaggagatataattaatcaaaataacagtgctaattgattgctgaagattcttagttgagaagtgcaagctgatgaataattgctgaacttatatttgaaataacctatggaaattacataagtaccaacacattaaatttgagatgcattatttgatttatttggagttatgaaacaaatgattcagtagttccttttgggtttgacatggnttatcagactttatgtcagcagattgttaattagatctcaaatccttgatatgcctatgcggttctttggttctagtaattcttggccctgattgttagtacactgc

SEQ ID NO: 964 - DNA, 389 bp, Zea mays
  misc_feature (61)..(61): n is a, c, g, or t
  misc_feature (84)..(87): n is a, c, g, or t
  misc_feature (96)..(96): n is a, c, g, or t
  misc_feature (100)..(100): n is a, c, g, or t
  misc_feature (104)..(109): n is a, c, g, or t
  misc_feature (112)..(112): n is a, c, g, or t
  misc_feature (114)..(116): n is a, c, g, or t
  misc_feature (162)..(168): n is a, c, g, or t
  misc_feature (172)..(172): n is a, c, g, or t
  misc_feature (264)..(264): n is a, c, g, or t
  misc_feature (269)..(279): n is a, c, g, or t
  misc_feature (281)..(281): n is a, c, g, or t
  misc_feature (304)..(305): n is a, c, g, or t
  misc_feature (307)..(323): n is a, c, g, or t
  misc_feature (325)..(338): n is a, c, g, or t
  misc_feature (342)..(343): n is a, c, g, or t
  misc_feature (362)..(362): n is a, c, g, or t
  unsure (1)..(389): unsure at all n locations
agagtagcgctacagcggggccgccacgccgagagccggggaagcaacttcgggcttgggnggggttggaagagcactgcacannnngggtgggangagnagcnnnnnnggncnnntggccgagccgccgggaaagttagacagctaatggaagcagcggcnnnnnnngtgntttgtgggagactgtgggccttatgtacctagagatgcagccacacgttattgggcttgagccagatatgtatgtttttcaggcctgtgggnaaccnnnnnnnnnnntntattacccgctccgaacccacanntnnnnnnnnnnnnnnnnntnnnnnnnnnnnnnngganngacactagtcttgaccgtnctctcacccctgcacaagcatatttat

SEQ ID NO: 965 - DNA, 1064 bp, Zea mays
  misc_feature (167)..(167): n is a, c, g, or t
  misc_feature (262)..(262): n is a, c, g, or t
  misc_feature (280)..(280): n is a, c, g, or t
  misc_feature (313)..(313): n is a, c, g, or t
  misc_feature (604)..(604): n is a, c, g, or t
  misc_feature (646)..(646): n is a, c, g, or t
  misc_feature (996)..(1056): n is a, c, g, or t
  unsure (1)..(1064): unsure at all n locations
ggctgcgagatgcataaacccgccggatgaaggatggagtgctttcacgttattgccgccggcagctgcgagcaagagtttccctgggtcagcgagggtcacggcagaggaagccgaaacggatccaaaggacatggaaggggttgcggacgaacctgacatggcgntctgctggtgcgatgcctgctgctgctgctgctgctgcgtcttgtcgcctggtcgcttctggtagaggcctagggcagcagcacctccggctccnggagccggaggagcgtangtgttggatatgaagaaatggccttgcgggaanggctgctgtttcatcgatgctggctgcgtatgtgagtgctgcttgctcccaggattggaaccaggcgatgcattaggctgctggccaaggatggatggcatggccatactgaaatgattcgtgggagtagtcctggagccagacgtcgacgcggagttcttggctgactgctgctgtggtgatggcagttggacaggctgctgaacaccctttgcatttcctgtggcgggtgggctgccaccggtacttttggacaccgaattggatggtgaaccagaagcaacaggggcntttgaagatcgagatagatcccctcctccggtagaaaggttngttagagaaggtcctacctttgatgaacttaaggaagtctgtgattggtgaccaggagtgtagagagcctgcatagggacttttgcttgttgctggtggagactactgttcttcatcataatcaaattagggggtgtggcggcaggggtagtcgtagcagtagatgaaggtgtccctctccctgaggatgccttcaactggggggattgaactctcccttgggcagcacttgatgggtacatcatattctgaaaattagccatgtttatacggtcttggtacccacctgcactgttctgtgtacttggtgcagcagatctgggccgattcagatggtgatgctgaattannnnnnnnnnnnnnnnnnnnnnnnnnnnnnnnnnnnnnnnnnnnnnnnnnnnnnnnnnnnnagaaatgc

SEQ ID NO: 966 - DNA, 623 bp, Zea mays
  misc_feature (94)..(97): n is a, c, g, or t
  misc_feature (230)..(230): n is a, c, g, or t
  misc_feature (252)..(252): n is a, c, g, or t
  misc_feature (285)..(289): n is a, c, g, or t
  misc_feature (321)..(324): n is a, c, g, or t
  misc_feature (346)..(346): n is a, c, g, or t
  misc_feature (483)..(483): n is a, c, g, or t
  misc_feature (491)..(491): n is a, c, g, or t
  misc_feature (580)..(582): n is a, c, g, or t
  misc_feature (604)..(607): n is a, c, g, or t
  misc_feature (617)..(622): n is a, c, g, or t
  unsure (1)..(623): unsure at all n locations
cactgctgggcaggtcgaggtttcttgcaagccaccgccgccggtgccggttccttgcaacgggcaggagggggtggccgacaagccaacccgnnnnccggggctctgtgcggctggctggatttttgtatataagattgacgactagtgtcgccaaaggacgatcccatacattgccacttgtcggggaggagagtccggagctgagacggcgagctgcctagctccgntcctgctctatatctcagctcntccgttctgtcctgtggccccgagctgagctgnnnnnccaaggatacgtacgtacgtacgtcttgaggnnnnctgccggtcgccctcttctctngtcgacctcgtcggggttatgcggaggagcaggtcgtgcttgtcctgcgtgcccatggggacggcggcgctgcccattgagaaccacttcgtcgctccggctgcgctaccgtcggtgcccgcctcaggtagtacatntatcatgntgataaagctcattgcttgaatacctgctgcattcatagctaatagtactcctgttcagcttgtttctgaacttgtccaatcactgacnnntttgcttactttccctgtacgnnnnctcttttttnnnnnng

SEQ ID NO: 967 - DNA, 719 bp, Zea mays
  misc_feature (44)..(44): n is a, c, g, or t
  misc_feature (587)..(587): n is a, c, g, or t
  misc_feature (608)..(608): n is a, c, g, or t
  misc_feature (610)..(610): n is a, c, g, or t
  misc_feature (612)..(612): n is a, c, g, or t
  misc_feature (618)..(620): n is a, c, g, or t
  misc_feature (626)..(626): n is a, c, g, or t
  misc_feature (634)..(637): n is a, c, g, or t
  misc_feature (689)..(689): n is a, c, g, or t
  misc_feature (691)..(693): n is a, c, g, or t
  misc_feature (705)..(718): n is a, c, g, or t
  unsure (1)..(719): unsure at all n locations
cgtcttgatggtggcgttgaccagcgcgctgagcggggacggcntgaacccggccatcatgaggcgcgccttccacttgccgaacacctcgtgccgctccacccgctcctcgccctcgcaggccaccaggttgacgatctcccgagccaggcagtgctgctcgatgttgatccgctccctgtcgcccctgggcagcgccaggtcgatggactcgaagatggccgcgtagtagtccagcgtctccgcgaaccgctgcgcgaagggggccgtgttggtgttggactcctgctccaccagcgtgagcaccctgggcgacaggcccttgaccagcctcaggacccggtccctgtggttcgccgtgctcacggtctcgtcggggatatggtgcagctctagagtaaagttgacggcgacggcttcgccagggacgacgcccagatgcccctcctccacctcgctgccggagatggcgaccgcgtcgaactgaaagggcaccttgtagaggccagcgatgtgtgacagcctcttgccgaccaactctaagccgccgcctcgggcgtaagctgaaacgggatcatcaatgccgntgaccctcacgaacggtggcncncnaggccnnnccgcangggcttgnnnnagagagacccactgcgccccctgagcgatgtggaagtcgatgatatggatcntnnnttctcccttgannnnnnnnnnnnnnc

SEQ ID NO: 968 - DNA, 641 bp, Zea mays
  misc_feature (17)..(325): n is a, c, g, or t
  misc_feature (355)..(457): n is a, c, g, or t
  misc_feature (550)..(557): n is a, c, g, or t
  misc_feature (563)..(567): n is a, c, g, or t
  misc_feature (581)..(583): n is a, c, g, or t
  misc_feature (606)..(607): n is a, c, g, or t
  misc_feature (618)..(619): n is a, c, g, or t
  misc_feature (624)..(625): n is a, c, g, or t
  misc_feature (636)..(636): n is a, c, g, or t
  misc_feature (638)..(638): n is a, c, g, or t
  unsure (1)..(641): unsure at all n locations
ggctgtccagctgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacacaaaatcgccaggaggagccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagttgcaggtaccgatacggccgtactgctactggtgccgtgtctggcagcaatctgatcctgtgatcatggcgattggcgacgcgaggnnnnnnnnccacgnnnnnccatgaagacatcnnntcataagagtggagtaatacatnnatgagattatnnccagnngtcaacactgngnact

SEQ ID NO: 969 - DNA, 688 bp, Zea mays
  misc_feature (270)..(270): n is a, c, g, or t
  misc_feature (587)..(587): n is a, c, g, or t
  misc_feature (610)..(612): n is a, c, g, or t
  misc_feature (630)..(630): n is a, c, g, or t
  misc_feature (669)..(672): n is a, c, g, or t
  misc_feature (681)..(681): n is a, c, g, or t
  misc_feature (684)..(684): n is a, c, g, or t
  unsure (1)..(688): unsure at all n locations
ctgagtacgttcacgaggaagaagctcaacaaatagcacctgaagtacatgatgtggtcgaaaactatacttattctgagccacaacagcaagtagtgtcggacaactggggagaggagcctcttcctgaagaaccgccttctttctcaaatgaaatggcagtcgctcctgaggagccagtgcaagctccacctgtgccacttcctcacgtggatgagcctgtttgtgaaccagtaaagaagacttatgcttccatcgtatgtcacttcntacttgctgtatcattttatttatttgacatcttgcctgatgcatctttaaaactacacttgactgattcatgcagctaaaaaccgcaaaggctcctgcattcccagtagcccagcaagtacctgtgagtaagacttctcaccctacaacagagtcaaaccaaacccagcattcagttatggcttcatcaatgggaaccgagaaaccgaggtctgatgtttttggtgagggtgcttcccatgatgacgaaggttgtcctatcctctgtgttaaacttaaacatcaaaatttctctggtgatttggctcttatgcatngtttactgacccaaccttttctnnncatataactagagagcanatctgtgtatgtcggcaacgtgccatcatctgtaagtgnnnntgatcttgnaantgag

SEQ ID NO: 970 - DNA, 615 bp, Zea mays
  misc_feature (139)..(139): n is a, c, g, or t
  misc_feature (156)..(156): n is a, c, g, or t
  misc_feature (168)..(168): n is a, c, g, or t
  misc_feature (205)..(205): n is a, c, g, or t
  misc_feature (296)..(297): n is a, c, g, or t
  misc_feature (328)..(328): n is a, c, g, or t
  misc_feature (493)..(493): n is a, c, g, or t
  unsure (1)..(615): unsure at all n locations
ctgcaccctgagctggtccaccagggacgtgaacgcgtcggccggcgtggtgggcaccacccggaagtccatggacatattgcgcgatcgcgcgaaattggtcagcttcgcgcccagctcctcgtaggacatgtcgagngccggcggcggcgcgcngggcgcgacgtnagcgaccgtgagccggaggatcgggggcccctcgggncggctggcgagcatgtcgatgagcatcgggatctgcatgcagtgcgtcgtgccgagctcgacgacgtgcacggcggggaagccctcgacgnnctcgaggatggcggcgttggcggccgtgtanccgaagcggtgccagggcgtgaggtcgacgaagctggcgagctcgacggccgtgaagcggtgcacgtggagcgcggccgactcgacggcggcggcgacggcggcggtgaccgccttgcacgcgccggtcctggacgcgcgcgcgacgagcgcgcagaggaacgcngccgtgaggcgctggttggagtccccgtccggcggcgcgatgttgttgagcacccacaggatctgctgcgtgagcgtggcgtcgttggcctcgatggcgttggcgcagtgcaccagcagggg

SEQ ID NO: 971 - DNA, 362 bp, Zea mays
  misc_feature (46)..(46): n is a, c, g, or t
  misc_feature (295)..(295): n is a, c, g, or t
  misc_feature (355)..(355): n is a, c, g, or t
  unsure (1)..(362): unsure at all n locations
ttgacttgaccggacagtgctgttcggtggctcggccgcgatgccngactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctnctctgggccatgaccacgctcggcttcgaggactacgtcgagccgctcaagctctacctncacaagt

SEQ ID NO: 972 - DNA, 719 bp, Zea mays
gccactgagctcgcttccttccttccttcctgccgtgacgtctctccgcgttgcgttgagcgtgcccgcggccgtttcgtgcgccggggtttgcttgcccgacgaaagcacggcactggtcttatcgccttgttgtttaatacggagtatataaatagtcgaaaggttgtccacaggacggcagcaccgtggcgcactgcattatatttatatgtatttgcagtaacgacatcattcgacagccattatgcagggctgtacacgtaacggtattgctcggcgattggacatgggcagggtctcgtggaacatgaaggggcatatatttcttaaggaagaaaagtaacggggaaaccataataattaccacgttcatagctagtgctatggtcattgcttggatatggtacggctaaagaacattttagatgtcagtattgctcggtattgctcggtgatgcatgaattggcccggccgtccgctgagggacggtagacggcggctgtgataccacgtcgtcaagcactgaccgcgcggggctcgcctgacttggcggatggccggtcgtgtgtgcccagtaggtttaccaaaccgtttttccactgaaaaccgctagtcactggaacgaaaaaaccgcccaaaaaccgctaatccaatgtccatagagccgtcgtaaagaaccacatgaaagctttgactttccggtgcccaaaatgca

SEQ ID NO: 973 - DNA, 218 bp, Zea mays
cgaggcagggcttaaaaagcttgatgagtaccttctcactcgcagctacatcactggctaccaagcttccaaggatgacttggctgtctacacttcgttttcggctgctccctcgtccaagtatatcaacgtagcaaggtggtttaaccacattgatgcgctcgtgaggctgagcggaattactgcagagggccaaggtgtgaaggttgtggtttaac

SEQ ID NO: 974 - DNA, 582 bp, Zea mays
  misc_feature (1)..(5): n is a, c, g, or t
  misc_feature (556)..(556): n is a, c, g, or t
  misc_feature (565)..(577): n is a, c, g, or t
  misc_feature (579)..(581): n is a, c, g, or t
  unsure (1)..(582): unsure at all n locations
nnnnncccaagccaaccatccaacaagcagtagataaacaagaagcagaaacagatgcgtctcctgcaccttctaaaggagagctttcaaggcggctgagtgtgaaggacaggataaacatgtttgagagccagaaaaaggagcagactccaagttctggtaacagcaactctgccggtactggtagagtggttccagggaaaggtgagcaccgcagggttccttctggcgcctccatggagaagttagttagaaggtggagcagtgttagcgacatgagtattgacctcagcaacaatgagagtagtagcttaaatgacaaaaaggataatggaactcctgccgggactccaacatctactgatttggaggccgactctaaagtaagagctaatgaggactctaatggacagaaggattcaatcacgtcacactcttggccttgtcaaaaggataatgtaccaatggatctggccaccacagatttgtgcccaccctcaattttaagtaatacacttgctcctcataaagagagtatatatggtgatggtgcagnaaacgacannnnnnnnnnnnntnnna

SEQ ID NO: 975 - DNA, 683 bp, Zea mays
  misc_feature (239)..(239): n is a, c, g, or t
  misc_feature (423)..(423): n is a, c, g, or t
  misc_feature (612)..(612): n is a, c, g, or t
  misc_feature (624)..(625): n is a, c, g, or t
  misc_feature (627)..(627): n is a, c, g, or t
  misc_feature (633)..(636): n is a, c, g, or t
  misc_feature (639)..(641): n is a, c, g, or t
  misc_feature (650)..(650): n is a, c, g, or t
  misc_feature (652)..(654): n is a, c, g, or t
  misc_feature (667)..(667): n is a, c, g, or t
  misc_feature (677)..(678): n is a, c, g, or t
  unsure (1)..(683): unsure at all n locations
cacctcgtcagttttcaacttgaaacagaaatttgcacataaaaaggaggctcattgctatcgcgtctcgtgacgatcgaatcggaaacaggccacacgacgtaggacacgcagacaaagctgggtcacgcaaagtcaaagagagataatgcaaccaccttcctaaaataaatcgattttgcctactagaaaggaggaataaaatgcaggagcgattagatactagagaaggttttttngttttcggtttcaccttgcaaatccaatccatggcgtctctcctccaggagtactccaatccgccgcgctccagcctctccgcatagccgtcttgaggcttgtggtccgtctccttctccaacaacgcccgcacggcctcatctgtgtccacggggaacacggcgccgacgacggagtccaagncgtcatggccgctccccacctccaccagctcgttgccgcagccgaggccgagtacgttgttcctgtcctccccgcagagcagtgtggaggaagcaccaaggcagaggattcccatctcagtcagtcaaaatcgtagcaaacagcggcctcctactgctgaagtacagaagtagaactagcagtactgcntggcactcgaanngnaatcgnnnngannntctctttgngnnngttttataatatngcgtgtgttnnaaaat

SEQ ID NO: 976 - DNA, 562 bp, Zea mays
  misc_feature (430)..(433): n is a, c, g, or t
  unsure (1)..(562): unsure at all n locations
tcgttcttttttttattccatctgattttgtgttatgtcacagtttatgatggtaagggaacccttgaggaaggggaaaccgctgaagcgcgtttcattaagatccaagcagcgtatgagctgttgattgatggtgaaaggagaagagcatatgatagagagcatcatgtgaatccgatgaaggtctgaattttcttggccacttaggttatcatttcattatgtgcaggatgcagttcctccactccatctttgtatttgtttgttaattactgttgtctgttgccacctattttactcgaggattacacattttagtcacagtattagttttttaatcctgatttagcttcatggttctcaagccaagaaaaggaagcatcattccatccttgtcagctactaacttacaaagcagtaatgtgtcttnnnntgtttttcttgcttcaaaactggactaggactgatggaatatatcagcaactaaaaactgctaattacacgtgggtccaacattcatatgccttgaaatagttgagcacttgagaccttattatctgca

SEQ ID NO: 977 - DNA, 590 bp, Zea mays
attgctttttgtcttgagggcacccataaagtgtcttgatgagcttgtttcatttgatggcatcttcaatttaggagattgcaagctgagattcttgcacatcaaggtgtcagaaagaagattgaaggtctcaaattggaagcaaagcgtaaagatgatgaggttcatgtcgaacttatacacaactatttgagatttgagttctttcttctcttaaataataatctaaaccagcgattctatagattggacaatacaaagagcatattgctgagttggtcctgcattcagaagcacagtccttgttgtttcaggagaaggtatggtacgctacctatatagttcttttttgtgtgtctatttctgctgtctatgtgctaataaatcttgccgtgcagtacaatgaaatggaacacatggtttctagacagaggtttggtccgcatgaatcttattctgagactgtccccaagactgaaaagccttcagggcgagcaagaggatccagctcccctttccggtgcatatctagcattattcaacaaatgaactctgagagagatcaagaaatcttggtggcacgccaacga

SEQ ID NO: 978 - DNA, 407 bp, Zea mays
  misc_feature (398)..(400): n is a, c, g, or t
  unsure (1)..(407): unsure at all n locations
gggtcttggcggccatgcatggggcaacgatcgagatcgacccggggcacgacggcggccgacggcggcgaggagggagacgatcgatccaagaggaggtgtgtccgtgcgtacgtgtgtgccgtgtgcacacggcagcgagcagctagggcatatgcatcatttcagaagagaactagctactccgatcaagatgagcgacgaaggattgtacgtatattgctgagaggagatcgaagagacggtgatgagttgcattggcggaaaggtcgatgcatgcgtggatgatcagccaatcgtacgtagtacgtgtgtaaaaggtcggccggagcgaataatggtcgtcgtcgtgcatgtctcgatcgagacacctctctcgctcgctcttcctctcctannncttaaaa

SEQ ID NO: 979 - DNA, 700 bp, Zea mays
  misc_feature (142)..(142): n is a, c, g, or t
  misc_feature (380)..(380): n is a, c, g, or t
  misc_feature (437)..(437): n is a, c, g, or t
  misc_feature (445)..(445): n is a, c, g, or t
  misc_feature (566)..(567): n is a, c, g, or t
  misc_feature (601)..(602): n is a, c, g, or t
  misc_feature (605)..(607): n is a, c, g, or t
  misc_feature (618)..(622): n is a, c, g, or t
  misc_feature (625)..(625): n is a, c, g, or t
  misc_feature (632)..(633): n is a, c, g, or t
  misc_feature (638)..(639): n is a, c, g, or t
  misc_feature (641)..(696): n is a, c, g, or t
  misc_feature (699)..(699): n is a, c, g, or t
  unsure (1)..(700): unsure at all n locations
catgcctgcagaacgagcaccgaccacataaacacgtccagttccatcatcctagtgattgtttaaaggttagagaagcatcccagttgtaaactgcaaataaaattattaaaaatgatatcattttttgcatgaaggggtncatatagcaaatctggaagccaaattcattttcatcatgaactgtaacttgataaacatttaaataaacattgacatatctgatgcttagaattatcatccatttgggacaagatcatgtacaatatcaacactacctaagctaggggctaatttaaggtttaagcctggccagcaagagctagcatggctggggctttggagcttgtaagctgagtttatccacacaagtgaaatcntagcttgccaagagaagaccataaacttagttgtaaagccaaatttgcataaattantgatagtnggagcccaggctaaattgaaagtcttatatttgaaaaagcaaagaaaatcacagtgtaatagctacagcagttatttaccagataccatggaacctctttgctaacagaaagcatcactgnngaatcttgaatccaggatccggcatcattgtgcnncannnagtgttgctcnnnnnacnaaaaganngttcnngnnnnnnnnnnnnnnnnnnnnnnnnnnnnnnnnnnnnnnnnnnnnnnnnnnnnnnnnaana

SEQ ID NO: 980 - DNA, 1120 bp, Zea mays
  misc_feature (1)..(7): n is a, c, g, or t
  misc_feature (30)..(40): n is a, c, g, or t
  misc_feature (386)..(386): n is a, c, g, or t
  misc_feature (599)..(649): n is a, c, g, or t
  unsure (1)..(1120): unsure at all n locations
nnnnnnnaaatggatggttgcagcatttcnnnnnnnnnnnaacaatgttcaaaagtgatacctgcatatgccatgatcaagtcagtttggtagccaatggccaagtgttgccttgtgcccatgctccagtttgctaggtaatgcacagtgaggtgaggaactgcttgcgctagcaatagcaggtgagaaagaatagtaacattgttccaagcaagataatcctggcaaacaccacagcttttagcaagaaaaacggtcctagactaccagcaacagtatatattcatgtatgaacataagggtcaacttgctacatactgagacaaccaaattacattcaattccaagataaaaaagagcggtaggccggtagctaacaaaaaaanccaaatgcacccattgaaataactaaaactaaagcctagaatcctacaaaatactcttgaagatgtcaggctgtggagtttagttggggcaacagtccttagaaggttatgccctagtttagggatgttggtctgtatattcctctacccccctccccttcttggctgcctgttcaggcagtttgtgatttggtcgtatacagaccacccccnnnnnnnnnnnnnnnnnnnnnnnnnnnnnnnnnnnnnnnnnnnnnnnnnnntaacataagccgcagaaaattaaaaaacataagaacttgattaaaagaacaggatgtaacaaaaacctgattcccacggactcctttatttagattctggaaattccgctctaaaatccacttgtagtatctagtaaaaaacaaaaaagtttagcctcaatgtataaacagagcaagttatagctccaggtccatggtccatgcaggatttggagcttgtaggaaaaaaacgaaaggtctaagaatatgggtttgatccaaactaataggaaaacttctttaaaaaaagaggttcaagaaaatcagaatgaagtactcactgtttctgaaggggtgacatctcgacacgtagaatccgttcaattttaggaggtaaagacttctcgacatcttttataacccgccttagaatatgaggcctcaattccttatgcagattcgcaagctataagaaaaccggcaaaagacgtt

SEQ ID NO: 981 - DNA, 1075 bp, Zea mays
  misc_feature (994)..(1003): n is a, c, g, or t
  misc_feature (1028)..(1033): n is a, c, g, or t
  misc_feature (1042)..(1048): n is a, c, g, or t
  misc_feature (1065)..(1071): n is a, c, g, or t
  unsure (1)..(1075): unsure at all n locations
tctgtaatagactagaagggataaactggcatcccagcacaaacttgacgagctgagccgctgccgttgcccaaactcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgctgtattacaagtttatgtcaaatggttaatacatacacaagcgttgttgtattacaagtttatgtcaaatggttaaatacaggaaaatctgtagcattgaaagtgacttacatgctccccaagtcagaccctccatctggacactgcggacagcctcctccagcttcttcatatcagtctcatcgtcccatggtttgacatccataaggacggaggatttaccacctgtaaatatatgcaaagccattaataactatcaagtcctaaaagtcaagtttctgcaagaaaaagtgattataagaaacactaacaagacctaaacaggttctacataaaatccaaatgattataagagacaatgtaggttaacactcctaaatgaaaattatgcatactttctttctttttagaagaggccttggcagcggcggcacgctcatcagctgccttcttgtcctcctcagtttcatcaccaaaaagatcaaggtcatcatcgtcctcagcctgtcgagaattaaaagcagaagacagtgacaacaaaaaagaagcattgatataaagcatacttggcatgcaattaatcacacaacgacaaataggttgatatttaatggaataaaaaataagcatagatcaactggaatttcttccccattgtttgaccaatcaatgaaaaattgtaccatgctaaatcaaacagaacagcactggcccattgtttgaccaataagacagattnnnnnnnnnntaaaaaagagatgtggcagtatggnnnnnnatggggagnnnnnnnctcatccgcaggagcannnnnnncagg

SEQ ID NO: 982 - DNA, 434 bp, Zea mays
  misc_feature (2)..(6): n is a, c, g, or t
  misc_feature (93)..(93): n is a, c, g, or t
  misc_feature (113)..(113): n is a, c, g, or t
  misc_feature (122)..(122): n is a, c, g, or t
  misc_feature (126)..(126): n is a, c, g, or t
  misc_feature (158)..(158): n is a, c, g, or t
  misc_feature (262)..(262): n is a, c, g, or t
  unsure (1)..(434): unsure at all n locations
gnnnnngactacatggtccacgacctcgccggcctagccgccagccccgacatcaagttcacgctgccccaggtcaagatcccattcagctgncagcctgacacagcatcgcncccaattangagnaatgcgactgataactgattgaggtgtttctntatcgggccaggtcaagtgctatgtgcaccagctgttgtcaggacttgagcattgtcacaaccggggagtgctacatcgcgacatcaaggggtctaacctgctnttggacaacaacggtgtgctgaagattgctgatttcggtctggcgtccttcttcgaccccaaccataaacagccaatgacgagtcgggtggtgacactctggtaccgcccaccagagctgctgctgggtgcgacagattatggagttggcgtcgacttgtggagcgcaggat

SEQ ID NO: 983 - DNA, 730 bp, Zea mays
  misc_feature (2)..(13): n is a, c, g, or t
  misc_feature (17)..(21): n is a, c, g, or t
  misc_feature (25)..(36): n is a, c, g, or t
  misc_feature (45)..(45): n is a, c, g, or t
  misc_feature (47)..(47): n is a, c, g, or t
  misc_feature (485)..(485): n is a, c, g, or t
  misc_feature (539)..(539): n is a, c, g, or t
  misc_feature (577)..(577): n is a, c, g, or t
  misc_feature (579)..(579): n is a, c, g, or t
  misc_feature (670)..(677): n is a, c, g, or t
  misc_feature (679)..(682): n is a, c, g, or t
  misc_feature (701)..(702): n is a, c, g, or t
  misc_feature (707)..(709): n is a, c, g, or t
  misc_feature (715)..(721): n is a, c, g, or t
  unsure (1)..(730): unsure at all n locations
tnnnnnnnnnnnnctcnnnnnctgnnnnnnnnnnnnggtgttcgngngttcagatttgacgcgattcgctcctcgcatgcagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaaggtaggtaccttggaatgcaatttcggtcttggccagcacccttttgatgatgtgatggttaaatgtgggaggctaatttcgatccatgtgccttgtggggctgcagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctccgtgccccncttgggcaaaacacggtatggctaactcgtgttggaaattcacctgtttttttngctgacggtaatgcttgatacagtacatcgaatacttntngatagcagaatataattctatctagtctggttgtgttttgctgtactaaaatatgtctggagtattctgatgaacctgtagatgctgtttnnnnnnnngnnnncactgaatgctctgtcctnntgcgnnncaatgnnnnnnncaaatccct

SEQ ID NO: 984 - DNA, 416 bp, Zea mays
  misc_feature (236)..(236): n is a, c, g, or t
  misc_feature (249)..(249): n is a, c, g, or t
  misc_feature (308)..(308): n is a, c, g, or t
  misc_feature (317)..(317): n is a, c, g, or t
  misc_feature (320)..(320): n is a, c, g, or t
  misc_feature (347)..(349): n is a, c, g, or t
  misc_feature (392)..(393): n is a, c, g, or t
  misc_feature (396)..(396): n is a, c, g, or t
  unsure (1)..(416): unsure at all n locations
ttccatgctgctgcattgtgtgttgctccgagagctggaagaatgaagggctgtaggagacgtgctgcattcccatattgaaatgctcgttattggacttcgacatctcgcccgttgctatcttaagcctctccacttcttgcctcagtgcatcatttagagctgcatcggtatgggtattccgtcagtaaataacagtcatatgaggatcagtgcaatggttgcaaaatttacanattgttccagcantactaagtactagctaaccatgtgttgaccatggacacatggtacagcttctgaatatnaaaaaatgngtnagctacctaagatgaagctaggctgcnnngacaatgggacaccctcccacatgaacttattatgaaaaaaannaantaaatgctcaccgtcacgca

SEQ ID NO: 985 - DNA, 523 bp, Zea mays
  misc_feature (11)..(11): n is a, c, g, or t
  misc_feature (69)..(69): n is a, c, g, or t
  misc_feature (80)..(80): n is a, c, g, or t
  misc_feature (89)..(89): n is a, c, g, or t
  misc_feature (175)..(175): n is a, c, g, or t
  misc_feature (209)..(212): n is a, c, g, or t
  misc_feature (214)..(214): n is a, c, g, or t
  misc_feature (217)..(219): n is a, c, g, or t
  misc_feature (241)..(241): n is a, c, g, or t
  misc_feature (254)..(254): n is a, c, g, or t
  misc_feature (263)..(264): n is a, c, g, or t
  misc_feature (371)..(372): n is a, c, g, or t
  misc_feature (380)..(380): n is a, c, g, or t
  misc_feature (385)..(385): n is a, c, g, or t
  misc_feature (392)..(392): n is a, c, g, or t
  misc_feature (395)..(395): n is a, c, g, or t
  misc_feature (443)..(443): n is a, c, g, or t
  unsure (1)..(523): unsure at all n locations
tatttcatgtnagaaagaaaaacacctcagagatatatgcaatgaaagttatgaggaaggacaggatantagaaaaaaancattctgantatatgaaggccgagagagagatattgacaaaagtcgaccaccctttcatagtgcagctgaggtactcatttcaggtaaaactgtntgtgtgcatactctcatccttattcatggtacannnnanaannnatgtgttaagtttggtgaaatnttaatacaaattntcgattgtnntgttctaactatgcagacgaaatatcgactttaccttgtcctggacttcataaacggggggcatcttttctttcagctctacaagcaaggattatttaggtaccttnnattttttnatagnaattttnttngccaaaaggcagtaacactagcactgaaactaaacttgtttttcatancaagggaggagcttgcaagaatctatacagctgaaattgtatctgctgtagcgcatcttcatgctaatggaattatgcat

SEQ ID NO: 986 - DNA, 899 bp, Zea mays
  misc_feature (9)..(12): n is a, c, g, or t
  misc_feature (16)..(21): n is a, c, g, or t
  misc_feature (23)..(23): n is a, c, g, or t
  misc_feature (65)..(65): n is a, c, g, or t
  misc_feature (143)..(143): n is a, c, g, or t
  misc_feature (210)..(210): n is a, c, g, or t
  misc_feature (327)..(327): n is a, c, g, or t
  misc_feature (372)..(372): n is a, c, g, or t
  misc_feature (379)..(379): n is a, c, g, or t
  misc_feature (503)..(503): n is a, c, g, or t
  misc_feature (690)..(690): n is a, c, g, or t
  unsure (1)..(899): unsure at all n locations
tgcctgcannnncccnnnnnngntcctccaggtcaaagctataggtgcaaccctccaagaacacnaacttattcttctcagcaatttggccgccgctactgaattcttgcttcggcttctcgctcctggtggcagtacccttncctttggattccacatcaatctcgtccttgcctttcctctttgaaaagcacacaaccacgactagcntcagcaatgcaaacccaccaacagcaactgcaactatgaaacccgtgcctagtttcttatcatgatgtgtcaaaggtggagattgaggcgatggagatgattcaggtgagcgtgctngtgaaggatgtgagcattcagctagaggtagcccacacagtccangattccntgaaaatgaaccctttggaaatttctggagagatcgaggaattgagcctttcagttcattgttgctcagatttaatagtttcagactgtgaagcttgaggtcagggatggatccagagaaaganttatcttgcaaattaagaacggttaactgagtgaggttttgtaaacttgcaggtacttctcctgtgaaggaattgtaggagaaatctattacactgaggttaggactgaaggaagaaggcaaccctcctgaaagttcattgtgctgtaggtatatggaacgtaaagacggaagggaggccacatcanctggaagacttccggtcaatcgattagaccgcaggctcagtacttgaagagaataaagcttgccaagagtgtttggagaaattactccgataagaccagcagccggtaccctcaattcaaaaacttgtgactgatcttctgagcattttacgccatgccatgaacaaactgaggtatgtttatcccagttgagcttgtttccatgatag

SEQ ID NO: 987 - DNA, 578 bp, Zea mays
  misc_feature (1)..(1): n is a, c, g, or t
  misc_feature (153)..(153): n is a, c, g, or t
  misc_feature (200)..(202): n is a, c, g, or t
  misc_feature (226)..(227): n is a, c, g, or t
  misc_feature (234)..(234): n is a, c, g, or t
  misc_feature (271)..(274): n is a, c, g, or t
  misc_feature (314)..(315): n is a, c, g, or t
  misc_feature (318)..(318): n is a, c, g, or t
  unsure (1)..(578): unsure at all n locations
nctcactgaagagtgacgatcgagctgttcgcacgcatgcacacatatagcgccatatgcaagcgctgtggtgtcagcagactagcaaattagagaggcttagctaagacacgtgcatgctcattgcacaggtggagtttagctaagaagctncgtcgtctggagcgtggcgagcaacacgcaccaaacatctgtgtggnnncaactataaactgaaaaatatatnngtgcttngattatagtagcaagcgctgctgaagctgaactagcnnnncaaataaagagttcatcgagcagcagtagtgccaagagannttngcatgacaaggaaaggcaggtcaagcaagaacacgcgaattaatcccgatggttgatggagactggactggagagcgaggcatgcatgaacctatatctttctatcaatctatcttatcaacaccaccacatgcacccagcagccaaccagctgcttattcttggcaagcagtgcgttaacgttaaaggcatgcatggtatctatagcggcacaaagctaattttgcgttttcttagccttttcgacccgtgcagaagct

SEQ ID NO: 988 - DNA, 1306 bp, Zea mays
  misc_feature (147)..(147): n is a, c, g, or t
  misc_feature (234)..(234): n is a, c, g, or t
  misc_feature (249)..(249): n is a, c, g, or t
  misc_feature (447)..(448): n is a, c, g, or t
  misc_feature (487)..(489): n is a, c, g, or t
  misc_feature (513)..(513): n is a, c, g, or t
  misc_feature (518)..(518): n is a, c, g, or t
  misc_feature (525)..(532): n is a, c, g, or t
  misc_feature (535)..(536): n is a, c, g, or t
  misc_feature (544)..(551): n is a, c, g, or t
  misc_feature (553)..(553): n is a, c, g, or t
  misc_feature (564)..(564): n is a, c, g, or t
  misc_feature (566)..(572): n is a, c, g, or t
  misc_feature (578)..(579): n is a, c, g, or t
  misc_feature (589)..(652): n is a, c, g, or t
  misc_feature (657)..(667): n is a, c, g, or t
  misc_feature (669)..(670): n is a, c, g, or t
  misc_feature (672)..(677): n is a, c, g, or t
  misc_feature (699)..(702): n is a, c, g, or t
  misc_feature (732)..(735): n is a, c, g, or t
  misc_feature (793)..(794): n is a, c, g, or t
  misc_feature (945)..(945): n is a, c, g, or t
  misc_feature (980)..(980): n is a, c, g, or t
  misc_feature (982)..(982): n is a, c, g, or t
  unsure (1)..(1306): unsure at all n locations
tttagagatctcgacaaatcgtcttttaattctgaacattccaagcctgctgcattacatgagaagactgaccagctaagtggggttggcgatgctgtgcagaacactgtgaaagatacctccaaaatggcacctcaaccttctgcnttcttgccagctcctgttactcagaccaattcatactccttaaggccgactgtttcttcttcagccacatcaggtgcgaaaacttcngatgttttatctagntcaatgcagaaagtttctccaatagtacctgggggtactgtgtctagctcagtccctactcctgctaaggattcatcaactggattgagtcaaaatgcttccaaacctgaaacgctaatatcaaaggtaactagtaccatagtttctgcaagttcgacttctgtcatatcagtcactgaaagcaaaccttcagtgccnncaacaactggcgccagcttgccttctactcatgtctctnnncctcaaacagcaccaacaacatcngaatnagttttnnnnnnnncannaaaaaatnnnnnnnnanacactgacacnannnnnnncgatgnngatgacatgnnnnnnnnnnnnnnnnnnnnnnnnnnnnnnnnnnnnnnnnnnnnnnnnnnnnnnnnnnnnnnnnggtcnnnnnnnnnnncnngnnnnnnaaagtctaatccttttggtgcnnnntttggtacatctggcaataaaagttcaggnnnnccatttactttgacaaccagtccaggacagcttttccggccagcgtcgctaagcattnnttcagctcagccagcccaaccatctcaatcaactagttctagttctttttctaattcgttctcaagtgggcttactggatttggacagcctgcacaaattggatctggccagcagtcagcttttgggaagcctgcacagattggagctggncagcatgcaggatttgggcagactgcccaaattcnanctggttttggccagcctgcccaaattcaatctggttttggccagtcagcacaaatcggaactgggcaacagtcaggatttgggaagcctgcacaaattggggctgtccagtcaggatttgggcagcctgcacagtttgctgctcaacagacacttggatcagtgctgggttcttttggacaacctccccagttaggaggcataggttctggaggatttggtggattttcaagtgcttctacatctgctggttttagttctttatcttcaggtaatgctggatttgctggtgctgcatcaggtgggggcttttcagcaccaactg

SEQ ID NO: 989 - DNA, 629 bp, Zea mays
  misc_feature (28)..(28): n is a, c, g, or t
  misc_feature (157)..(159): n is a, c, g, or t
  misc_feature (234)..(234): n is a, c, g, or t
  misc_feature (467)..(467): n is a, c, g, or t
  misc_feature (492)..(492): n is a, c, g, or t
  unsure (1)..(629): unsure at all n locations
gggaatctgcaccagtaaaataaagggngaggacacaaagaatacacagctataaagctacctcaacttgcttatcatctcccgcagaaattcttgcgagtgccataatgacagggagaagaacattagctgatgcatgcctaaaatcatgagaagnnncccaattagtcacatcaaggagtaccaggtagccttatataatatgcacactgcactaggaaaatgaatcagacnacttacatcaaaagatttacaagttgagggcaaaccccagcatctaatacatcttggacagcatcacctttatcgccacatatgtagtaaacagtccagcatgcatctgccagtatcttctcgtcagcagagtgaataagctggctgataatttctagtattggtttcacctacagtgcccaatcaaagcagattatcagcaaaccctttatccgcaaactgaacaaaaaaanggaacaaagatagcagtaacaaaancctacttgcacttcggctggcaattttccaaaacaaagatttgacagtgcccacatagcagttctcagaactggaatcttcatgccttctctaaattgagaaagtaaaggtgtaagagcaccatgatcgaagagaat

SEQ ID NO: 990 - DNA, 914 bp, Zea mays
  misc_feature (7)..(67): n is a, c, g, or t
  misc_feature (429)..(429): n is a, c, g, or t
  misc_feature (666)..(666): n is a, c, g, or t
  unsure (1)..(914): unsure at all n locations
tgtctgnnnnnnnnnnnnnnnnnnnnnnnnnnnnnnnnnnnnnnnnnnnnnnnnnnnnnnnnnnnnnaggctttcactgcactagaaacatgtgatgatagctacaatgaagctccatcatcagaggactggaggaaagttgaggccgcctgtaattacctgaaactgctctacgactccgcacatagcatcatggcagcagcaaacccaactgcaaacatctttttccacgaagcatggaaacttcagctagagctagcaaatggcacaggacatgaagaccccactttcagaagcatcgccaaggatatgcatgagaggtttgacaagtactggaaagattgcagcctcgtgttggccgttgccgttgtcatggatccacgtttcaagatgaagcttgttgagttcagttacacaaaaatttatggngctgaagcagcaaagcatgttaaggtggttaatgatgctgtacatgagctgtacgaggagtatgtggctcatccactcccactgaccccagcctatgtggagcaaggtgaaggggggaataatggagcagcaaatgcgaatagcagtcaagggcctcctgcttccactggcgatgggcttctagacttcgatatgtacctttctgagatccagagtagccagccctcgaaacctganctggaacagtacctggatgagtccctcaccccacgtacccaggagtttgatatcctgaactggtggaagctaaacagagtgaagtttccaaccctctctagaatggcctgtgatatcttggccattccgatgtccatggtaagcagtggcagctccatattcactgctggaacaggaagccgcatgctcgatgactacagaagctctctccgacctgagacggtggaagcacttgtctgtgcaaaaga

SEQ ID NO: 991 - DNA, 553 bp, Zea mays
  misc_feature (3)..(9): n is a, c, g, or t
  misc_feature (21)..(21): n is a, c, g, or t
  misc_feature (35)..(64): n is a, c, g, or t
  misc_feature (79)..(79): n is a, c, g, or t
  misc_feature (152)..(152): n is a, c, g, or t
  misc_feature (157)..(157): n is a, c, g, or t
  misc_feature (192)..(192): n is a, c, g, or t
  misc_feature (206)..(225): n is a, c, g, or t
  misc_feature (256)..(256): n is a, c, g, or t
  misc_feature (273)..(284): n is a, c, g, or t
  misc_feature (299)..(299): n is a, c, g, or t
  misc_feature (342)..(342): n is a, c, g, or t
  misc_feature (515)..(537): n is a, c, g, or t
  unsure (1)..(553): unsure at all n locations
gannnnnnnatttgtctttgnctttcctttccctnnnnnnnnnnnnnnnnnnnnnnnnnnnnnngtccttcctatattntagctagcatcttgttgcaaaccatatactcctactatgcattcgcggtgtacggacctgcatatataatggnctctntttttttaagggcaggcaatggcagttatggctgnttttttttataaannnnnnnnnnnnnnnnnnnnggttcaattaaactgtcacaacattccaaanttcagcctgatgcgacnnnnnnnnnnnnaacaacaacaaaaangtggagcacaatgaagagcagcatgtgcattgcttggatagcnccatccatccacagttccattccaagagtttttgtcaccattgcttgccttgctgtacattgaggttccatccatcctggtagtagtctttacttatatcatcatgctgattgtcagtgacattggtaccttctttggatgtagtatcatggatgggggaggggcgtaagatnnnnnnnnnnnnnnnnnnnnnnncatgctagtgctagca

SEQ ID NO: 992 - DNA, 691 bp, Zea mays
  misc_feature (14)..(14): n is a, c, g, or t
  misc_feature (37)..(37): n is a, c, g, or t
  misc_feature (177)..(177): n is a, c, g, or t
  misc_feature (190)..(224): n is a, c, g, or t
  misc_feature (306)..(306): n is a, c, g, or t
  misc_feature (419)..(419): n is a, c, g, or t
  misc_feature (427)..(427): n is a, c, g, or t
  misc_feature (609)..(610): n is a, c, g, or t
  misc_feature (617)..(618): n is a, c, g, or t
  misc_feature (631)..(632): n is a, c, g, or t
  misc_feature (654)..(654): n is a, c, g, or t
  misc_feature (667)..(669): n is a, c, g, or t
  misc_feature (671)..(673): n is a, c, g, or t
  misc_feature (677)..(678): n is a, c, g, or t
  misc_feature (680)..(687): n is a, c, g, or t
  unsure (1)..(691): unsure at all n locations
aattgcgcgaaagngtactgtttgctacatgcgcganggcatttaatcccagcacatgcatggtacaccacaccttcaccctcaataccgatgatgttcacaaatcacagcagcggcagcacaatgacagttcctagcacatccacagtggaatttcatttccattgcccacgcatntgggtgttaatannnnnnnnnnnnnnnnnnnnnnnnnnnnnnnnnnnaggttctgaaatgaaagctaaagcgcttgaatacacaagctcccaggctcgagattgtttcagagagcaaacaaggccgatnacagcagcttggggaggtttacagcgtccagagatcagacttaccataaacagattcaatgaaccccccgggcattcgtctcatcgccttttcttcgtggtcgcatttgaagncggggcanaattctgctcggtaaccatctttataagattcacaagggaccgcaacctgtcccacacgctatagccatacagagtctccacaagcaactgctggaactcaaatccatgctctgagacgggatactgcaaaaacaatacgaaaatttgataagcagtcgaataccatagcagagccacaagnnccaagtnnaccatgcaaatcnngagtacttgtatcatggggacnggggaagaagtannncnnnatanncnnnnnnnncact

SEQ ID NO: 993 - DNA, 691 bp, Zea mays; identical to SEQ ID NO: 992
  misc_feature (14)..(14): n is a, c, g, or t
  misc_feature (37)..(37): n is a, c, g, or t
  misc_feature (177)..(177): n is a, c, g, or t
  misc_feature (190)..(224): n is a, c, g, or t
  misc_feature (306)..(306): n is a, c, g, or t
  misc_feature (419)..(419): n is a, c, g, or t
  misc_feature (427)..(427): n is a, c, g, or t
  misc_feature (609)..(610): n is a, c, g, or t
  misc_feature (617)..(618): n is a, c, g, or t
  misc_feature (631)..(632): n is a, c, g, or t
  misc_feature (654)..(654): n is a, c, g, or t
  misc_feature (667)..(669): n is a, c, g, or t
  misc_feature (671)..(673): n is a, c, g, or t
  misc_feature (677)..(678): n is a, c, g, or t
  misc_feature (680)..(687): n is a, c, g, or t
  unsure (1)..(691): unsure at all n locations

SEQ ID NO: 994 - DNA, 787 bp, Zea mays
catcttgcatgcctgcagcacaacatgcatctattttctaaaggaattatgttgcccgaacctgtcttctagcatatacttgtctgccattataggtacaagtattaaaatggaaccagatatgtctgttaacttcttactgtcctatatggctcatttcctctgttctaaactcttcagttttatatgttattacagatcatgaaaagggcgtcggagactctaatacctgtaactctggagcttggtggcaaagattcatttattgtgtgtgaagatgtagatttacccagtgtaagggagtctatgttgcctatgcatgaacattatattttcttaatcctaacagtgtactgaacctaatttgtcgtcttttcctgtttgaaggttgttcaagttgctactagagctgctctgcaatctagtgggcagaattgcgctggtgctgaaagattttatgttcacgatgacatctattctgcctttgtttcacagatagtgaagacagtcaaatctataagtgttgtaagtacacagccatattttgcagccaactaccttgccccaatttatcactttactactggtttacaggaccacaaccttgtgttggcatttctgcattattatctgttattgctatgtcttataaacaagtgtaaatctgtgaattaactaatgagactgggtgcattttcacatttctaacctctttattttttcatattggggttgtttttcaaggtttacatgaaaaatttgttagttaatggttatctaaaattta

SEQ ID NO: 995 - DNA, 1073 bp, Zea mays
  misc_feature (6)..(8): n is a, c, g, or t
  misc_feature (45)..(46): n is a, c, g, or t
  misc_feature (121)..(121): n is a, c, g, or t
  misc_feature (125)..(125): n is a, c, g, or t
  misc_feature (132)..(134): n is a, c, g, or t
  misc_feature (213)..(213): n is a, c, g, or t
  misc_feature (342)..(342): n is a, c, g, or t
  misc_feature (545)..(545): n is a, c, g, or t
  misc_feature (600)..(600): n is a, c, g, or t
  misc_feature (686)..(686): n is a, c, g, or t
  misc_feature (778)..(778): n is a, c, g, or t
  misc_feature (788)..(788): n is a, c, g, or t
  misc_feature (818)..(818): n is a, c, g, or t
  misc_feature (858)..(858): n is a, c, g, or t
  misc_feature (860)..(860): n is a, c, g, or t
  misc_feature (864)..(864): n is a, c, g, or t
  misc_feature (876)..(876): n is a, c, g, or t
  misc_feature (925)..(925): n is a, c, g, or t
  misc_feature (969)..(969): n is a, c, g, or t
  misc_feature (1056)..(1056): n is a, c, g, or t
  misc_feature (1066)..(1072): n is a, c, g, or t
  unsure (1)..(1073): unsure at all n locations
ctgcannnatattatctaatacatatatacatgtttagtccttanncctgccactttctggcaattggtcatggtctatctgggcattgaagtactgaatcaaggagaataactatgaacngtcnaaaaaannncatgttcacaggttagagagaatccaccaaagcatatactaaaaagtgaagaatattaattgcatgagcttaagaaaanactacttcagatgagaagtataccatttttccaacacctggtgatcccacaaatattattttgtctactgatgatacaagagcttggcctgtttccgcaaaactaaaaaccaacaaaaaacagagtccnggtaagaaatgtgcagctagcctgtaaactaataagaatttagaaagctgcactcatacccagttattatgtgcaccagattctcaggtgcaccaacagctgaaagagctgcttgtataatacgaaaataaaagcagcccgaccaagtcgcatgttctgagacctataaaaggtaattttaccattcagaataatcatgaatnatgtataatgcacatcagaaaaattagatattttagaggccacaaaaatgtctangagcagcacaaaggcatatataacatataaatacatttaacttagaaaaacaagaaaataagttaatgacacaattgtatgcagtnttgccatgctacattctttctcggacaatgcaggaggaagggagagaattctactagcattcggtataaataaaaaatcaatccaataaaanctcagtaganaattgttctgcatttatttgacaagggtgntttctatgagccaacatatgctcaatatgaaatttactantntctngaagatcatacnaggttaacccaacaaaagtataattgaagataggatacagaacataaantatagctctcagcttcaatggtggcacataatacatgagatatnaagattgctgaataacaaaaaaattgatctatgggtccacgtctccacgatatgtacatgaaaatggttggttaaagaacaaatttnaaaaaaaatnnnnnnna

SEQ ID NO: 996 - DNA, 715 bp, Zea mays
  misc_feature (80)..(80): n is a, c, g, or t
  misc_feature (401)..(401): n is a, c, g, or t
  misc_feature (453)..(453): n is a, c, g, or t
  misc_feature (478)..(478): n is a, c, g, or t
  misc_feature (599)..(600): n is a, c, g, or t
  misc_feature (602)..(602): n is a, c, g, or t
  misc_feature (608)..(613): n is a, c, g, or t
  misc_feature (622)..(623): n is a, c, g, or t
  misc_feature (679)..(680): n is a, c, g, or t
  misc_feature (686)..(687): n is a, c, g, or t
  misc_feature (689)..(689): n is a, c, g, or t
  misc_feature (693)..(693): n is a, c, g, or t
  misc_feature (702)..(702): n is a, c, g, or t
  misc_feature (706)..(707): n is a, c, g, or t
  misc_feature (710)..(713): n is a, c, g, or t
  unsure (1)..(715): unsure at all n locations
gtctgacgggggcgaggtagtagttgttggcgatgtcgtccgacccggcgcagacaaggaacaggctttcggccacgatncctgcggcggcggcctcgtctccgacgacccctgcgagcctctccttgtactccgcgaacatgttgagctcctcctgcatcggcagaactgcctgaagaaaggcatttcaacgggggtcgttcgtttgttgtttaccacgagagtggaggtgagcgggtcgtagccggtgcccccagacgcgaagctgacgcccgtgcagaggtcgtcgtcgctgaggtcggtgccgagatacgccggaaccagatctttcaagccgagccgtgaagctgcacaggcatccatacagcgactgttcgttaattaggctcgtgctcgagtcngcatcgcagctagcggcgcgggacacgaacctacgaagtccgtcggaatccngccgttggagaagcgtccggtgggnacgccgccgttgaggtccttgccgtatggcctgaagttggacttggtgagcgtgaggacggcgttgttgttgcccgtgtccacgatggagtcgccgaacaccaggatggccggcacccgcnncntgccgnnnnnnaccgccctnncctgctgcaatggcgacgcggcgagcacgagcagcagcagcagcagcgacattgcnntaccgnngngctncatgagctntatnnctnnnnac

SEQ ID NO: 997 - DNA, 706 bp, Zea mays
  misc_feature (49)..(49): n is a, c, g, or t
  misc_feature (506)..(545): n is a, c, g, or t
  misc_feature (571)..(571): n is a, c, g, or t
  misc_feature (606)..(608): n is a, c, g, or t
  misc_feature (621)..(621): n is a, c, g, or t
  misc_feature (630)..(637): n is a, c, g, or t
  misc_feature (643)..(643): n is a, c, g, or t
  misc_feature (645)..(645): n is a, c, g, or t
  misc_feature (666)..(666): n is a, c, g, or t
  misc_feature (668)..(669): n is a, c, g, or t
  misc_feature (673)..(675): n is a, c, g, or t
  misc_feature (687)..(700): n is a, c, g, or t
  misc_feature (704)..(704): n is a, c, g, or t
  unsure (1)..(706): unsure at all n locations
agctgacaacagctccaaaccaaacaaatttaaggtctttaatctgtangccctccttcctagtcatcctgaggcaccaaccgacaggaccgcttgcaattgaatagcctcgaaacatccaaacagcacacaatcagtctctggtaggcgccaagtcactaaccaatggacccgctggcacatgatggagtaaattggaatgtccaaataggatgattgtgtcgcaagggctcacatcatggcatgacagctgactgaagtgaggatatggtaagcatctagcttgtcgtatatcacaattctttctgtaaaggtggatgcaagaatttagagatcttttgttggttcgaagcagtttgggcggaaaatattatgtgtgttttcttctaaaagcaggtgttatctacttacaagtagaagtaggttttttcatctcattcaatggtcacaaaagaattttcccttcatggcatgttaaacaaatagatgtcctcaatgacaacccnnnnnnnnnnnnnnnnnnnnnnnnnnnnnnnnnnnnnnnnctactaaacagaaaaataatgtaacnctggaactctagaagtgtgatgattattctggatnnntgagagcgtcagncacctacannnnnnnnacactntncatatatttactactacctcnanncacnnntatatgacgctnnnnnnnnnnnnnntaantt

SEQ ID NO: 998 - DNA, 1206 bp, Zea mays
  misc_feature (485)..(486): n is a, c, g, or t
  misc_feature (544)..(544): n is a, c, g, or t
  misc_feature (622)..(622): n is a, c, g, or t
  misc_feature (631)..(632): n is a, c, g, or t
  misc_feature (638)..(642): n is a, c, g, or t
  misc_feature (785)..(785): n is a, c, g, or t
  unsure (1)..(1206): unsure at all n locations
ccacccagcaaagagtccaacagtcaatgccttcattgtgcagattggtagtccacctttagtgcccgttcggttcttccggaatactttactggattggttccggattagaatagttcacaaatttgtattagcttgatgagttggaatggttctggcctccaatccggactaaacgaacagagccttaagaacgttagtgctacgaatgctgaaatccagacatcttatgtcagtgtcatttgaacaatgttgacctgtcgaccttaacattaactgagcctcagttacagaaacttcatcacaagaaggttccagatttgtggttgataaagtttatctcagatggaatcagtcgagaaattcctctggtactgataaggggtcaagctccaaatagcctcgaagcttgccacctttttcatgtgtgagacgaaagcaaggaatctggtgagagaacttggggtactcatcgttccttattnncatcacagaaccctctgctctgtatgacataaataccatcttataaccatcgaccttncttagaagctgaacttgtatggaggaatcagtatggccaagtatctccaccagttcatactcacatttttcaaaatcntgtgcagtnnatacannnnnccagtttttgtaaaccgcccatatctcaccatgacgaggaagtatttcatattcaccttttctgccagtagctctggccttaacaggatgagaaaagggatctgtaccagtgtaagtcatcatatcgaagatatagccaagcntaaaggttccaatgccaatggtccgttcttcttgggacaatcttttctccacttctcctcgaggacagacatccagccatctaacttgtactgtaccatttttaagatcgactttctgtatgaatgcatagtaattggggaatttatctatatcactatagagagcccagatttgcccagatgaaaacttttggagaaatcttattcttgaaaaatcatagaattctgattcagcgcatacatactctgtttggcaaatgttatcgtcatcgacatctgtaacttcaggcagatgagtgttatgcttgattttctcttcatttggtgtttttgtagcgatccctgcattcacagattttgtctgttgccgctgccccacattcatggttcctttgcaatcttcactggacaaaccagcatg

SEQ ID NO: 999 - DNA, 722 bp, Zea mays
  misc_feature (328)..(328): n is a, c, g, or t
  misc_feature (507)..(507): n is a, c, g, or t
  misc_feature (625)..(625): n is a, c, g, or t
  misc_feature (642)..(642): n is a, c, g, or t
  misc_feature (670)..(670): n is a, c, g, or t
  misc_feature (672)..(678): n is a, c, g, or t
  misc_feature (681)..(683): n is a, c, g, or t
  misc_feature (698)..(698): n is a, c, g, or t
  misc_feature (713)..(714): n is a, c, g, or t
  misc_feature (716)..(721): n is a, c, g, or t
  unsure (1)..(722): unsure at all n locations
ctgcagtacccccaccgcctacacctgctgccccgccaaaggcgtcgcctatacgcccccctgcggccgcgtcgccacccccatccaatctgccagcgcccaacccgccggcggacccaacgccgccgacagtagcacagccacctccgccacggcgccggccaccaagatcgcctcagacagaacctccacccctggcaccaccaccttctggaattcctgtcgaaccttccccaaccagtccctcaccgacgtccgcagatccttcgatccccactccctctagcccctcgtctccagggacgacaccgtccacaccaggctctgntggcactccatcggtgccagccccagcaacgccaggtgactcagttagcccggtaacaaccgggggccaaggttccaacaagtcgtcgagtccagcctcgcagagcagcagctcctcagtagacagtggtggactgtcttctggtgcaaaggcaggcattggggtagtcgttgccattnttgtgcttagtttggttggagcagcattttggtacaagaagaaacggaggagagtgcatggataccatgctggttttgtaatgccttcaccggcctcgactcctacacaagtgttagntaattctcatttgatanagtgcatttgcagcaattacacgtctgnannnnnnngannngtctttatatgtacntgagtcatgaaatgnncnnnnnnt

SEQ ID NO: 1000 - DNA, 961 bp, Zea mays
  misc_feature (460)..(460): n is a, c, g, or t
  unsure (1)..(961): unsure at all n locations
gtcagtgatcgatgtgttgcactcataccttgaaccattcttcaaaactactacaaacctttgtaattgcaagctaccaactcttgggctcgtcttcttcttcatggaccatgtcttcgagttgatcaatctgtgtcatggcagcagccaccaagaatggctcaagaacattgccggtgacatgtccaagacaactcaaaagttcacatctgaagcttacaacatcttcaccttcacagccgcaattcttgatccaaggatcaagggagagctcatccctgaaactctgaactccacgagcaacttggaagatgtaagaaaccattttgtccgggactacagcagcaccttccaagctgttggaaatggtcatggcgctcaggacaccacagaggatgctggtgcgttcgcctttgctgaagagattattcgcaaaaggcgccgggtgagcatgaccacngctgatgatgagctctcgcagtatctcgcagagccccccgcaccgatttccactgatgcccttgagtggtggagggggcattcctcccgctatccacgtctctccctgatggcccgagactttttggcaattcaggggacctcattggatcctgaagaactgttcacaagtaaaggggacaacatccacaagcagcagtactgcctccctcttagtagcatgcaggctatagtatgcataaagtcatggatgcaaagtgggtaccagttcaattttcagtcgactatcatagattttgagagattggtcgaatcagctactgctcctgatgatatcgatagttctggccttcacagctaaatgcatattcagcaaatcaaggatcccagaatagttctttggtttctgttttttcttcttttttctaggtgctcatgtaaatagtccttagaacttgtgaatgcgacttctattgctgtcccctgcaaaatcccagggtca

SEQ ID NO: 1001 - DNA, 496 bp, Zea mays
  misc_feature (10)..(10): n is a, c, g, or t
  misc_feature (133)..(133): n is a, c, g, or t
  misc_feature (162)..(162): n is a, c, g, or t
  misc_feature (227)..(227): n is a, c, g, or t
  misc_feature (236)..(236): n is a, c, g, or t
  misc_feature (243)..(243): n is a, c, g, or t
  misc_feature (330)..(330): n is a, c, g, or t
  misc_feature (379)..(379): n is a, c, g, or t
  misc_feature (424)..(424): n is a, c, g, or t
  misc_feature (487)..(487): n is a, c, g, or t
  unsure (1)..(496): unsure at all n locations
gaaccgcgtnatgccggaacattgcggcaagtgatatcatcgccacaagaacgcatcctgcaagaagcgccaaccccaacctgacggtaaaactactgacgggtttcttctcgcatgccatcctgtaatgctngaaaccttcatctatggcaaacacggagnaatagcatggacattctctgagtagttgccttgattgtattcgtttccatctgacatcaggaacnttctactgntcttctnatagagtgttagttcaaacatctggactgaaacaagtggcgtttgttgagagatttttctcaggctccagcagaagaacatgaagcnctactggtcctgaatgggttgccgtgcgaagttagatgagcgaactccnggtagaaaagaagcgaaagcaaactacgtgtctcactcacctttnggtctggtaggaatgtgtgtgggtactgtgcacattgaaagtctgcatgtttgttgcagtagngagcaaata

SEQ ID NO: 1002 - DNA, 719 bp, Zea mays
  misc_feature (84)..(84): n is a, c, g, or t
  misc_feature (264)..(264): n is a, c, g, or t
  misc_feature (393)..(393): n is a, c, g, or t
  misc_feature (398)..(398): n is a, c, g, or t
  misc_feature (408)..(408): n is a, c, g, or t
  misc_feature (632)..(636): n is a, c, g, or t
  misc_feature (641)..(642): n is a, c, g, or t
  misc_feature (644)..(645): n is a, c, g, or t
  misc_feature (654)..(654): n is a, c, g, or t
  misc_feature (656)..(670): n is a, c, g, or t
  misc_feature (672)..(682): n is a, c, g, or t
  misc_feature (688)..(693): n is a, c, g, or t
  misc_feature (703)..(703): n is a, c, g, or t
  misc_feature (705)..(716): n is a, c, g, or t
  unsure (1)..(719): unsure at all n locations
gcgtacttgacattgggactgggagtggcagactcttgcagcagcttgcgaagcaggggtatgctaaggaaatgttaagctttnattttttgcattgttaatgccagcactgacctgtcaatttacaatatacaggttttctgatctgactgggattgactatagtgaaagtgcaattgagcttgctcgtagccttgcaatcggtgatgggtttgagcacattaatttcttggtgagtcagccgctgaagcatatattataatntgtagattcacctcgacatgcatgcccacatttgctgtccttgcccttcactttataacatatccccaatggttctcgttgtatcttaggtgcaaaactagccttaatattataagagcagaaaagaantattngagtttatangaatggtccttttgcaggttgatgatgttttggagtcgaagttggagagaaggtttgaacttgtcatggatgaagggactcttgatgcgattgggctccatcctgatggacctgtgaagaggtaaatgcatgtgaaaatgttgatgtgttttttagtccttgtgtagtattcacactggtgcttacatgttttcaattgctaaactttttaatgcggaaaggannnnntgatnngnntgcacatgncnnnnnnnnnnnnnnntnnnnnnnnnnngcattnnnnnntgatgtattngnnnnnnnnnnnnagc

SEQ ID NO: 1003 - DNA, 778 bp, Zea mays
acttgcacatccgccatgtaacaacattcttgatgtcaatcggcttcttgattcagtatgtacttatatcctggttcttctacattgttcaaaatccgctggaaaaaaaaggatatctccgtgcagttcattttttttctcgaaaaacgcaggagtgtttgacacttgttagagcataatttcattactctcatacggtggtaacacgaaaaacctttttaatataagttgataagtcctgagaagagttataatttgtgtataggttttggaaacatctcagcatgttggaaggtcgtcagtgtcaacaaaccaggatctgcctttcaaggacgtagccaaccaatgtgaagcacttctgattgggaagcagcaaaagctatctgagtgcatgagtgtctgtgaaaaagaggttagagatccttagcaccttgaactgtccacagttaaacagctgccaataagtagaacagtattcattggcggttggacgttatgtgaactgagtacatttttgtcacttatttttattttgcatttcctttaaaaagttgctgtttcaatattttatctgataggtgaatttaaaatgagatattgagattcaacccaggtggaactaaatgtgcatgtgctcacaaggttcttaactttcaggatggtgaatcttccgtcgagcagtcatctcggcaggatcctcaagcagatacgtttctctgcacagctgatgaacaatggcaccccaattcctgtaagctgccagcgctgtgtccctacg

SEQ ID NO: 1004 - DNA, 1150 bp, Zea mays
  misc_feature (100)..(100): n is a, c, g, or t
  misc_feature (105)..(106): n is a, c, g, or t
  misc_feature (284)..(285): n is a, c, g, or t
  misc_feature (312)..(312): n is a, c, g, or t
  misc_feature (320)..(320): n is a, c, g, or t
  misc_feature (328)..(328): n is a, c, g, or t
  misc_feature (440)..(440): n is a, c, g, or t
  misc_feature (487)..(487): n is a, c, g, or t
  misc_feature (525)..(525): n is a, c, g, or t
  misc_feature (530)..(531): n is a, c, g, or t
  misc_feature (548)..(548): n is a, c, g, or t
  misc_feature (552)..(552): n is a, c, g, or t
  misc_feature (581)..(581): n is a, c, g, or t
  misc_feature (1102)..(1105): n is a, c, g, or t
  unsure (1)..(1150): unsure at all n locations
ttccagcaaaagactgaaagaaagatacaagcaaatttagtcaatggcaacccttctggcttcaatcataaagatgacacaatgctcattagtagtagcntgagnnatatacaagaatacagctacattttgcacaatttactgtgaaaaccataacctatgccccagaacataaaatggaaactggaagataagcggaactacagttacttgacagcacacatccaacaacgatcctgcctttcctacccaacacacacacacaaacacggaaaacaaaaaanngaagcagaaaagcaaaatgatgataancaataatngtgaaatncgtagaatatagaatagaaatgggagctaggagcagcagtagttggcaattggcattagtagagatgaagacaaaatggtgaactcctatttgctttataaaaggaaattgnggaagatagcagttaataacatagctgtaacaaaatcagtgatatgnacacatgtaccatactgaaaggaaattgtggaagatancagtnnataatacaactgtaacnaaancagtgatatgtacacatgaaccttaccgnaccacaacagtgacgttcttagtcaaaatttcaaatgaaagaacaaaatcacttactcttccagcacttaagagtgaacagctaggaggagatgggtgtccagtatttgcttcttgccctgcaacgaatattgtaatgagtatgacatgtcgaactattgaacttagaaaagcatcaccgaagcagttgtacaaaaactaattagattcccataaggaaaaaccactatatgttttcggattaactagaacttccatcaacatggcaacaattggttttctgacaaccagcaagcaatacagaatgagcagaaatgttgtcacactcaagtcacaatctcatatgagtaacggaccatgatttcggacgccgagcactgtcattacacatggatgatcaagcacatgcaaatattagcaacactacttatcaaggagaagcttccaactgaaattggaaccaaaacgcaaaaaaaaaattccaaggctcaaaagcatcaagactcactgctgactaccccnnnntgacgcttaagttttggacacagtaattcagccgatagaaaggat

SEQ ID NO: 1005 - DNA, 591 bp, Zea mays
  misc_feature (545)..(554): n is a, c, g, or t
  misc_feature (557)..(557): n is a, c, g, or t
  misc_feature (561)..(561): n is a, c, g, or t
  misc_feature (563)..(577): n is a, c, g, or t
  misc_feature (582)..(590): n is a, c, g, or t
  unsure (1)..(591): unsure at all n locations
tagtcagggatagacggtcgactgaaatccacccggcgatttttttttaatttcagtcggagggtgggggtgaagcttcgccatcaccatgagtcgtagtcccatccatttgatatttgcacgtcatcctccagctgctggtgtatgcctggtcctagtacaagaggacgaaggtgttgctgagccctgctgagcctgaagcaaagcaaaggcgaaggtgttgctgcaacttcattatttctatggaatggccggatggatatggtactctgtattgcattggcatggggatggatatggagaatgtggctcctttttgtgcgcacttgcaggtgcacagtatggtcaatgttcctacctgctataaacttatggagtttgtttaatgctgtcttaatctattttaaaccttatttttatttttttctcgaaagcgcaagagagctgcgcgaaaatatattaagaaggagataaaggtccaaaaggactcgaaaccttatttttattatgtgtttgatttcgtctgacagtactattttggtctnnnnnnnnnnaantggngnnnnnnnnnnnnnnngaacnnnnnnnnng

SEQ ID NO: 1006 - DNA, 438 bp, Zea mays
  misc_feature (21)..(21): n is a, c, g, or t
  misc_feature (153)..(153): n is a, c, g, or t
  misc_feature (265)..(265): n is a, c, g, or t
  misc_feature (293)..(293): n is a, c, g, or t
  misc_feature (403)..(403): n is a, c, g, or t
  misc_feature (433)..(433): n is a, c, g, or t
  unsure (1)..(438): unsure at all n locations
gagctcagcctcagccgccgngacggggacagggaaagatggccgacggcagtgcctccgcctcgccgccttccgtttctccgcaccagtaccaccgcgacgccatcaagtcctcaggtgcaccctcgcgcttctctcctgtctcctcccgcnggcgtcgcttcgtcatcgcgtcgaacactaagcgcgcgcggccgtggcagaagccctaacctgtgtactccctcctgagctggcgtggcggttctgttgctcccggaaccangagcggtgagcgcgctaagtgctctacngcctactgctatagccttatttgggaataacttcgcctacaccggggttcgataactgtttgctcgagcagtcgagctgattagaatcgggactcatcttattagcaggnttaggtggtaagggacttggtttgaggggnttatt

SEQ ID NO: 1007 - DNA, 497 bp, Zea mays
  misc_feature (6)..(6): n is a, c, g, or t
  misc_feature (32)..(32): n is a, c, g, or t
  misc_feature (222)..(222): n is a, c, g, or t
  unsure (1)..(497): unsure at all n locations
caaagncgcagcaaactctagacgaacagganatcatacatatcttcgtcaacatcgtcgactccgtgctgaggtactgtccagacaagaactcgtcgttccggttccctggggcacagcagcctcgtggcaacttcagtgacgtgttcaacatagctttcttgtccctggccttcctgctgtgcatcttcgaggtccctcgcgacctccgtccgggatgcntgggctcgctaggagcccagctcaccggttccaggtgcagagatgccgcaaagagcctcgtgaggatgctcggtgccaacctcgaggaccagtggatgcagacgatgaacctcgcagtaaccaactggatagtcgagctgagatcctcgagccgctcgtccggccccccgtcgccgctcttctcatagccatgggtatggaggaagctgcagagacaccacaggatgagcgtctcctcttctcactcatttatcaacaagtcgagtgtgtcattc

SEQ ID NO: 1008 - DNA, 543 bp, Zea mays
  misc_feature (270)..(270): n is a, c, g, or t
  misc_feature (288)..(293): n is a, c, g, or t
  misc_feature (324)..(324): n is a, c, g, or t
  misc_feature (371)..(371): n is a, c, g, or t
  misc_feature (378)..(379): n is a, c, g, or t
  misc_feature (403)..(494): n is a, c, g, or t
  misc_feature (509)..(513): n is a, c, g, or t
  misc_feature (528)..(539): n is a, c, g, or t
  misc_feature (542)..(542): n is a, c, g, or t
  unsure (1)..(543): unsure at all n locations
gtcagggtcaggaaggacggatgggcaagcgatgccatgctttatgtaagcgcgatctttcaactgcattgccggccatttgcagttttagtggcactgctttggattaggataataatagacgtggatggcaaatgtttgatggaaatgacatgtgtaactgatagaattgggtgtggttaactgttcaggtggacgtggagctcgtggacgcgaacacacgcccggacgtcgatagggcagtctcgttcagggagaagccgagaacgnacatggcgcctccgccgnnnnnnacaatgcgaggtagccgcaagagcttggagncagcgacgtgccatgatgtccttgacctgaagcagctgcttgatctngctgagnnggaaggccgggtggccgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcccggaaccnnnnncgacgtcgaagcgcnnnnnnnnnnnntgna

SEQ ID NO: 1009 - DNA, 657 bp, Zea mays
  misc_feature (185)..(185): n is a, c, g, or t
  misc_feature (404)..(404): n is a, c, g, or t
  misc_feature (439)..(439): n is a, c, g, or t
  misc_feature (461)..(461): n is a, c, g, or t
  misc_feature (471)..(471): n is a, c, g, or t
  misc_feature (522)..(523): n is a, c, g, or t
  misc_feature (528)..(531): n is a, c, g, or t
  misc_feature (534)..(536): n is a, c, g, or t
  misc_feature (540)..(546): n is a, c, g, or t
  misc_feature (548)..(553): n is a, c, g, or t
  misc_feature (569)..(572): n is a, c, g, or t
  misc_feature (576)..(581): n is a, c, g, or t
  misc_feature (583)..(584): n is a, c, g, or t
  misc_feature (586)..(588): n is a, c, g, or t
  misc_feature (590)..(590): n is a, c, g, or t
  misc_feature (593)..(600): n is a, c, g, or t
  misc_feature (609)..(611): n is a, c, g, or t
  misc_feature (613)..(615): n is a, c, g, or t
  misc_feature (618)..(627): n is a, c, g, or t
  misc_feature (635)..(638): n is a, c, g, or t
  misc_feature (641)..(646): n is a, c, g, or t
  misc_feature (648)..(655): n is a, c, g, or t
  unsure (1)..(657): unsure at all n locations
tgcatgaaggcagcgggagtctatcttgctcagggcccagttacatgggcgggacaggagggctgcaattgcccaatgctgttggcataagtgcaaatatctgggtctttatgataccgatgtctctctttatttgatcgtacaaagcgaggttctgcggacagcttggacgcagcatggagcangcgtgatccaagacgcctgctacgttagcaaacggatgtcgcgagtcgctaaggctctgcacaaaattggaggaacataagagatgagaatagcctgtaaccacagcttctccggtctcgataacaaggcgcgtcagtattttaccttgattgaaagaaccgtggcgatgccgttcgatatcaggtcagaaggaagttgggcgccacgggcaggttcanaacctgggcctgcacaacctgccacttgatttgangtgcataccttttcatcctcantacctccagngttcgcctatgtaacataagcaacatatcgaagaaactatgagcaatctgnngtacnnnntcnnntaannnnnnncnnnnnnttgacatacctgcatnnnnttgnnnnnnanntnnntngcnnnnnnnngtgatcttnnngnnnatnnnnnnnnnnatgactcnnnntcnnnnnngnnnnnnnnac

SEQ ID NO: 1010 - DNA, 732 bp, Zea mays
  misc_feature (327)..(328): n is a, c, g, or t
  misc_feature (334)..(334): n is a, c, g, or t
  misc_feature (407)..(407): n is a, c, g, or t
  misc_feature (525)..(525): n is a, c, g, or t
  misc_feature (537)..(537): n is a, c, g, or t
  misc_feature (702)..(702): n is a, c, g, or t
  unsure (1)..(732): unsure at all n locations
ctgaaatctgcaagaagcagtattgagattaccaaaccaacaagatcctgcagttaagttcaacagaaccaagatcagcattcagcacaaaatgaactgattcataatcactctgtggacagtaacagtggcagagaaagacctgatgcccaactggtttcgaattgtgcaagatatgagaaaatgggtaaaacaaatctctcctgtcttttagtgtccttaagctattactattgagaactccaccagtgatccttttgcgcattagagcatccttaatcctggactgacttagttgagtatcagcgagcatgttctgtgtgctgnntagtanaataataagccatcataaataataatgatgataaacgaaatcaataacataaaacacataataactcacgtgntctgtgtgctgcgtagtataataataagccatcataaataataatgatgataaacgaaatcaataacataaaacacataataactcacggtgtgtgttgctctatttttactctaggncttccatcaggntcggtaagtgcagcttctccttcaacagcataaacaagaagaccaagttggcagtaccctaatgctgtagcttggaaccaggcaagatcaacacggataccattctcagctaaagagggatttgcatgagattcaagccagttgatgaccggaagaaacgttacnttcagatttccaccacggaccaaacgcagg

SEQ ID NO: 1011 - DNA, 576 bp, Zea mays
attcaaaagggaaacgaagatggcttgtttattagttcagttgcctctagctcaaatctgtgggctttaattatggatgctggcactggctttacatctcaagtatacgaactttctaattactttcttcacaaggtaagcaatcaattccgttgacttcaaagatctgtaagggtccttccccttttttcttcttaatataatgatattcagctctcctgcttatttgagagaaaaaaaccttcaaagatatgtaagggttcttcctctttgtaatagggtctttacccttccttttcttcttcttaatataatgatacacaatttctcctgcttattcgagaaaaaaattgagagaaaaaaccttcaaaaatttactgttctttgtttatgattgtacgccaacacttcactgattatacatcctcaatgatgtctcattgtcattcgcatgcttgtactgtgttaggaatggataatggaacagtgggagagaaatttctatatcactgcactggctggggcgaataatggaagctctttggtgattatgtcaagaggtaattaatgtaaatg

SEQ ID NO: 1012 - DNA, 797 bp, Zea mays
  misc_feature (58)..(185): n is a, c, g, or t
  misc_feature (187)..(187): n is a, c, g, or t
  misc_feature (203)..(203): n is a, c, g, or t
  misc_feature (283)..(285): n is a, c, g, or t
  misc_feature (378)..(378): n is a, c, g, or t
  misc_feature (382)..(382): n is a, c, g, or t
  misc_feature (415)..(415): n is a, c, g, or t
  misc_feature (426)..(426): n is a, c, g, or t
  misc_feature (431)..(432): n is a, c, g, or t
  misc_feature (456)..(456): n is a, c, g, or t
  misc_feature (458)..(458): n is a, c, g, or t
  misc_feature (627)..(627): n is a, c, g, or t
  misc_feature (700)..(700): n is a, c, g, or t
  misc_feature (702)..(703): n is a, c, g, or t
  misc_feature (715)..(715): n is a, c, g, or t
  misc_feature (729)..(729): n is a, c, g, or t
  misc_feature (731)..(732): n is a, c, g, or t
  misc_feature (747)..(750): n is a, c, g, or t
  misc_feature (753)..(758): n is a, c, g, or t
  misc_feature (762)..(771): n is a, c, g, or t
  misc_feature (777)..(778): n is a, c, g, or t
  misc_feature (783)..(792): n is a, c, g, or t
  misc_feature (794)..(795): n is a, c, g, or t
  unsure (1)..(797): unsure at all n locations
ttgaataggatacatatgaaaaaagagaaattaaaggcctgtttggttcactacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncntgtatcagcttgaaanccaaaatatgtttggcaaaacatagcacatttatcaagaaatcatagaaggcaaaatgcaatatgctaatggaaaaggcnnncaggtgactacgatatctctcaacaggatatacaatgcttgagatggagttcgccatactcagaaatttgtttgacatgtgtcattttataantttnttttagaagctaggattcagacttcaactggantagatcaagtnaatanntaaacagtattctttcatactaananatatcaccttgtaagattcctcaagcctgtccttgtatttttcaaccaacagctctttactcaatgccagatctctttccactactgcctctgtctcaaactattaagagacaagagaacacattactctatctattcaaaacaattcctgtaatcaagtgataatatnactataaccaactaaacatcatgaaaaaattgcagtgcaatacctgaataacaatgtgaggatacaatgtttntnntttacggattgntggatcaagagtgntnncaacaaatgtatgannnntgnnnnnntgcnnnnnnnnnncatgcnntgagnnnnnnnnnntnnca

SEQ ID NO: 1013 - DNA, 687 bp, Zea mays
  misc_feature (6)..(6): n is a, c, g, or t
  misc_feature (44)..(44): n is a, c, g, or t
  misc_feature (74)..(74): n is a, c, g, or t
  misc_feature (145)..(145): n is a, c, g, or t
  misc_feature (236)..(236): n is a, c, g, or t
  misc_feature (443)..(445): n is a, c, g, or t
  misc_feature (501)..(506): n is a, c, g, or t
  misc_feature (509)..(509): n is a, c, g, or t
  misc_feature (518)..(520): n is a, c, g, or t
  misc_feature (527)..(528): n is a, c, g, or t
  misc_feature (530)..(532): n is a, c, g, or t
  misc_feature (537)..(537): n is a, c, g, or t
  misc_feature (543)..(543): n is a, c, g, or t
  misc_feature (549)..(549): n is a, c, g, or t
  misc_feature (553)..(553): n is a, c, g, or t
  misc_feature (561)..(565): n is a, c, g, or t
  misc_feature (570)..(575): n is a, c, g, or t
  misc_feature (578)..(586): n is a, c, g, or t
  misc_feature (588)..(604): n is a, c, g, or t
  misc_feature (608)..(612): n is a, c, g, or t
  misc_feature (614)..(654): n is a, c, g, or t
  misc_feature (658)..(686): n is a, c, g, or t
  unsure (1)..(687): unsure at all n locations
ggtagncagctgcgcttacccgactgtctgcggcgcgtacggcntctgcgtcagcgggcagtgcacgtgcccanccgcgacgtacttcaggcaggtcgacgaccgccggaccgacctcggctgcgtgcccgtggccccgatctcntgtgcctcgacgcaggaccaccggctcctcgctctgagcaacgtttcttacttcaactacgtggataccaaggccgcgctgcctcggatgntcgacgaagagagctgcaagaaggcatgcttgcagaactgctcctgcaaagccgcgttcttccagtacggcggcaacgacacctcccagggctcctgttacctgccgacgcaggtcttctcgatgcaggtgaaccagtggcaagaaactcactacagctcttctgcgtacctcaaggtgcaggtcacaaggtctcctcctcctcctnnngtccctggtccctcgaattcgaatgggacggccatacccgcagggaaaggaaggannnnnnctngtgaagctnnnatcgttnncnnngcacntgcggnggccantgcnttactagnnnnnatcgnnnnnnccnnnnnnnnncnnnnnnnnnnnnnnnnncgtnnnnntnnnnnnnnnnnnnnnnnnnnnnnnnnnnnnnnnnnnnnnnngatnnnnnnnnnnnnnnnnnnnnnnnnnnnnng

SEQ ID NO: 1014 - DNA, 832 bp, Zea mays
tttctctctcctcttgacttgttgaggcatttatcgccacctccagttctcgacttgctgcatgcatcttgagaatgaggggatcagtaaatgcccaaaagtccatgccagcacctccccaccccccatgaacaatcatggacagatgctagagaacaaaagagaagcaaagccgctgctgtgactcttgttcaagatatgactactggactgtaactcctcttgaactcgtcttataaactaaaactgggagggactaccagcaaaagcaaacgctctttgcagagttggagtgatcgagagcaagatagcagattatttatttattcaactgctggagcctggtgagtggtgagtggagaacggagaggagaggagggggttgcgagaaaaggaagggacgacttgaggggggtcccggtgtctgttgcagatatgaagcgacgtctctaaaggctatctctactccctatagcagtagcagctcgacacagccaagactgttcttgtctgtttcttctctgcgtgtcacgcgtaggctttactacctgaatagctctgtcagcggcgacctttctgtgctgccgtctctcgttttctgctccttttgcctgggcccctggtctgaactgtaatactgatcgaaacattgtcatatgtaattcagattcagagttttttttttaaaaacaaaacaaaaagcagagcttcgcttaggttgaagttgaagctgagcgaaaagttacaccatcttttaccgaaacttgagtagaatctaagggagaaagacaagtagctccgttctgctaccatatattagtagagtaaaaca

SEQ ID NO: 1015 - DNA, 608 bp, Zea mays
  misc_feature (73)..(73): n is a, c, g, or t
  misc_feature (89)..(89): n is a, c, g, or t
  misc_feature (119)..(119): n is a, c, g, or t
  misc_feature (230)..(230): n is a, c, g, or t
  misc_feature (393)..(393): n is a, c, g, or t
  misc_feature (443)..(444): n is a, c, g, or t
  misc_feature (469)..(469): n is a, c, g, or t
  misc_feature (492)..(492): n is a, c, g, or t
  misc_feature (494)..(497): n is a, c, g, or t
  misc_feature (507)..(509): n is a, c, g, or t
  misc_feature (511)..(511): n is a, c, g, or t
  misc_feature (522)..(522): n is a, c, g, or t
  misc_feature (558)..(558): n is a, c, g, or t
  misc_feature (561)..(563): n is a, c, g, or t
  misc_feature (569)..(570): n is a, c, g, or t
  misc_feature (572)..(577): n is a, c, g, or t
  misc_feature (579)..(596): n is a, c, g, or t
  misc_feature (602)..(606): n is a, c, g, or t
  unsure (1)..(608): unsure at all n locations
ctaagtggtgtcaatggcattctattttatgctgcgagcatcttcaaagctgctggtacattcttcaaaacangatcaatctctgatgntagattctaatgcaattgagatatgctttntggcttgcgtattcttgaacttgtccaggaaatgaaagataccttgttttggttcgattcatgctttgcatggagacactgtgacaatgattcatttactatgtaaaaaangggaagagttctagaacctaggcttcatcaaagtctgatatcttcctgaattctcttcctcaacaggtattacaaacagtaatctagcaacatttggtttaggggctgttcaggtacatttgttttaaagttgttacatcccttgtttctcagacaaattttnggcagatgtgggcttggcactgcatacttaatgggatcttgtcgtttcanntgattgctactggagtgacaacctngttgactgacaaagctggtcgangnnnncttctcattnnnantttccaacttnccatcacaattgtttattggacatgcttttccagtnttnnnaattgnncnnnnnntnnnnnnnnnnnnnnnnnnaatggnnnnnac

SEQ ID NO: 1016 - DNA, 549 bp, Zea mays
  misc_feature (223)..(223): n is a, c, g, or t
  unsure (1)..(549): unsure at all n locations
tattcaagcttctgtacaatggtcaacctgcttgcttggcacaatctcctcagttgcacaagcagatggctctatgtggtggttttgaacgagtatttgaggttggccctgtgtttagagcagaaaattcaaacacacacaggcatctctgtgagtttgttggtcttgatgctgaaatggagattaaggagcattattttgaggtaagtttgtaagaagaatncaatatttaattgtctgaagcagtcattattaattacaacttatacacaggtctgtgacattatagatggcttatttgtatcaatatttaaacacctgactgaaaactgcaataaagaactcgagacgataaacaggcagtatccatttgaacctctgaaggtaagcattcttgcttgtttgtaatttgagtatttgactatgcagttctatggttctgtagcctaagagattgacagatcacttataatgttatgcagtatctagacaaaacattgaagctcacttatgaagaaggagttcaaatgttgaaggtacaaacttgca

SEQ ID NO: 1017 - DNA, 1031 bp, Zea mays
  misc_feature (266)..(266): n is a, c, g, or t
  misc_feature (855)..(855): n is a, c, g, or t
  misc_feature (1026)..(1027): n is a, c, g, or t
  unsure (1)..(1031): unsure at all n locations
ggttaactcactagtgctactggtatgctggcttttatggaaggataggaaccaccatgtcttcgaggcagtgtcaactaacccagctacgctgtttgagttcatcgtcattgaagggaacacctggattgcggctggattaaacgcattgtcgattctgttactggctgagctaaggagatgctaattagtcgcaaaactagtgcgttgtaacagcttgttggagttcaggctttcagccatcatccgtttctatgttttttgcntttccgactgtgctggctagctgctgggcaactcgcccattggcatgttctttcgctttgtaactctacttcctacttaatgaaataagtgtgtggcatgttcgtgaaaaaagaagtgaaagctctatcctaatgcaattcacaaaattgcaaaatgcatgccatgacaggagtgcatagagaattacagtatagtgggtacttagaaatgaatcatgtgattttgctgatttttaccttcccaatagggtaagaaattggatagcagatgaccatgagaatgcgtacgagccatacaaagttagcacccactgctagaccatatctagtacagattgcttgtggtataacctgatgtcaaagcactacactatcagtcaaaccacacaatgagcaaatggtaaattttggacatcagatgaatacctctccaaaggcaagaacaaatgtcactgacaatattacagcaacaataggatgaaacattctgtcaagaaatataggaagtgcctgaaaaggttgcaatgagataaaaataaaagtcaatggttaaaacagaatggggtgcaaaagatatcagaaaaaaaancaatatgtgacctatgccctacctatcaacaactttagaatacagaaataagaaagaaataaggtataagagtatcaaccggtgatagtagatttaggataaagaaaataacgttgatcagatatacatgcaccaattacgatgtcattggactaacacaaactgaccatnntgca

SEQ ID NO: 1018 - DNA, 490 bp, Zea mays
tccgagctcggtacccctgaagctatagctgctgctgctggggagtggagagtgagtgagtgggaatcttctgcagcttctgcttcttctccttgcttgtgtacaaataaaaatcccaacttcaacttgtcatggcctccttttcagacttgttattatacctgacgtcctcgttggtgcctgggtcacatcacaccaccaacggggtgccattttgtgtaaaagaaatttacagtcacttattagcttgctaagattgttgacaaaatatatagtatttctttggaaaaaaaaaacagcagcaaaagtaactgacagaaacaggttggcaattagctagcaagctgctgctgctgatcatctgggagttcttttacggcctcgtcgacatgcaaccgcgatcgacgagaggtccgtccaccaccaattccattcttcttctcttctcatctctagcactagcacaaagattgcattgcattgcattgca

SEQ ID NO: 1019 - DNA, 648 bp, Zea mays
  misc_feature (1)..(1): n is a, c, g, or t
  misc_feature (8)..(12): n is a, c, g, or t
  misc_feature (581)..(587): n is a, c, g, or t
  misc_feature (589)..(593): n is a, c, g, or t
  misc_feature (595)..(595): n is a, c, g, or t
  misc_feature (603)..(603): n is a, c, g, or t
  misc_feature (605)..(605): n is a, c, g, or t
  misc_feature (611)..(638): n is a, c, g, or t
  misc_feature (640)..(646): n is a, c, g, or t
  unsure (1)..(648): unsure at all n locations
ntgcctgnnnnnggacatgagtactctgaatccttggatccaatgggtgcagtacttttggcgttcgcctcaaatgcaagaaaaatggatgggataataacagaaccaatcagtacaccatatatgtgcccagccactacagctctcggggaggtcgaagtcatatagccagtcttaaggtcttgcatggcttgtgaagacacattcagagctgcaacagacaccccacaggctgcaaggctagcgatgaccgcaccaggcacggcaacccatgctgctatgacgaactgtatgaacctgccataagattgtgcaactgaccagtctgtgagtcctgttccgtacgtgttgcagaaggtgaaaacgggaagaatggtgaacagaagggccatgtggtagagtttaatgtgttggaagatccaagggatgacgactgagcatactattgcacatccgatatatccagcaaccggcacatggagcgggattctctgaccaagaaacacatcaagccttctacgatcatcatagctaaggctggggcttgtcaacatgtatttgatcttccctgaatcattttnnnnnnncnnnnngnataggtcnantgagcnnnnnnnnnnnnnnnnnnnnnnnnnnnncnnnnnnnca

SEQ ID NO: 1020 - DNA, 508 bp, Zea mays
  misc_feature (464)..(477): n is a, c, g, or t
  misc_feature (479)..(481): n is a, c, g, or t
  misc_feature (492)..(496): n is a, c, g, or t
  misc_feature (498)..(500): n is a, c, g, or t
  misc_feature (502)..(502): n is a, c, g, or t
  unsure (1)..(508): unsure at all n locations
gaacattctcttgcagcaacagccatctcacgagcactaacatccttggatggctcccacagacttgcatccttatggaagagagtaccaatcttctctccttggagaactctaacaatgctctgagatgcaaatccacttcaagaataaaaaggaagttaaaccaattcgctatccatcatacagagacaaacatagattacagcatatgaagtttacttggttctctcaaggtgacaactgatgaaatgaacactgttagacaagcattactccatccattttgcaatgtttgtccatagcataccaagcgcagagactactgaagtattgttccaagaaaaattcaaattaacatgatacaactactcttctttcaacacatctaattaggggagagtggaaacatagcaataactacactcctgatatcctcaatagacaaacaatgtgcaacacatttnnnnnnnnnnnnnnannnacattgaaaannnnngnnntntttgga

SEQ ID NO: 1021 - DNA, 568 bp, Zea mays
  misc_feature (6)..(6): n is a, c, g, or t
  misc_feature (157)..(157): n is a, c, g, or t
  misc_feature (160)..(160): n is a, c, g, or t
  misc_feature (208)..(208): n is a, c, g, or t
  misc_feature (232)..(232): n is a, c, g, or t
  misc_feature (241)..(241): n is a, c, g, or t
  misc_feature (483)..(483): n is a, c, g, or t
  unsure (1)..(568): unsure at all n locations
ctcgtngtcccaggcggcgtggccgacgtagaacctcaggtcctgggtcctgatcgcgccgctgttcatcagggcggcggccttctcgaggtccgtccggaagccgtagcagatgcctggcaccacctcctcgaaccccttgaggcgcgcgctgtcntcngtcctcaccaggaacatgctcatgtcgacggggcctccgaagaagagnggggagtcgccgaagggcgtcgcntggtctcgnaacatcgggttcacgtgcttgatctttgtgtagagcggacggttcatgatgactccgaacgggccatcgaacgtgccccttgtaccgagcctgaggaggaagatgacggttctttcgaagatgctgtcgtcgtctagcgcttcggtagcaaccagaacgcatcctgcctctggcatcgtaatagcatgagcccacttttgagggagctgtaatggatctcctgaggacgccttcgactctgntggagtacttggatccactaatagctcctgattcagagacagaagcagatatgaaaaaccccaaggtatatggctgcgctcacca

SEQ ID NO: 1022 - DNA, 730 bp, Zea mays
tgctcgacatgatcccaccagcccatgaggaagttgtccaccaccagcctgaaccaaggggacatcttaacgccatcttccccagcatcagctttcctgagcagctccttcagctgatcgcggttcacgtacttgacgtcggccacctcttcaggattcgggttgagcttcacgtcacgaaccatgaacaggaggtaatccactgaaacaacagaataggaaaggttgtaaagcctgcaactgcaagacagacccttgaaacatgtagagtacagcaaacacaaatagtatgaaaactgggaatccaggatgtgatggcaaaaaggtaatcaagtatgtacactcgtgttcgccccattttccatctgaaggagccatgtaaagcatcctcccaaggaggatgaactggtcaacaggtaattcgtcagcaactattcccagttcatcaaatagtttgcgttgggctgcatttctcacccctgaacagaataaatgattgtggctggtgatgagtagagtgcaagtaacaatatggatggtgcatacaaatctataaagtatggattggtttctcactctccaaggaacatgtatatacctgcacaattttcctcaatcaactctgactcgcggtagagaggatggctacagcaggtgtttgtccagacaagtggaaatgtcacttttgtgcagacctttgctgtaaggatatgaggtaccatatcttctt

SEQ ID NO: 1023 - DNA, 807 bp, Zea mays
  misc_feature (34)..(34): n is a, c, g, or t
  misc_feature (103)..(103): n is a, c, g, or t
  misc_feature (198)..(198): n is a, c, g, or t
  misc_feature (207)..(207): n is a, c, g, or t
  misc_feature (263)..(263): n is a, c, g, or t
  misc_feature (283)..(287): n is a, c, g, or t
  misc_feature (299)..(299): n is a, c, g, or t
  misc_feature (351)..(351): n is a, c, g, or t
  misc_feature (358)..(358): n is a, c, g, or t
  misc_feature (365)..(365): n is a, c, g, or t
  misc_feature (380)..(380): n is a, c, g, or t
  misc_feature (413)..(413): n is a, c, g, or t
  misc_feature (470)..(470): n is a, c, g, or t
  misc_feature (523)..(524): n is a, c, g, or t
  misc_feature (617)..(623): n is a, c, g, or t
  misc_feature (672)..(678): n is a, c, g, or t
  misc_feature (694)..(700): n is a, c, g, or t
  misc_feature (702)..(706): n is a, c, g, or t
  misc_feature (710)..(717): n is a, c, g, or t
  misc_feature (720)..(739): n is a, c, g, or t
  misc_feature (743)..(745): n is a, c, g, or t
  misc_feature (750)..(806): n is a, c, g, or t
  unsure (1)..(807): unsure at all n locations
gcctgcagtggtgaagtcggagctgctttggttntgagggtgcaacaaagctccacaacgatggcaaattgttctttttctcaagaggtcgtggcttgttgcnagtgagtggcagcttagtatgggctttgactgaggttttttgtgggaagtcggagttgcttatcactatcttgggattaagctcggcaacgatgncgcacggtnggctacattggttgtgtgacacttttgtgtatttgtgggttgcttagggttagctntctgggctgttatgtttagnnnnngtatttttggtnggtttccctttaataaactgtgccattgtgaggtttttaggcttggtttccntcataanctgggtnaattctatctctcantctctcctttaattgaaaggcaaagatcctgcnattgcgttaaaaaagaaatatgagagtctctaaccaaggatagaaataaaacatganggagaaatgcttattagctatcaagtagggtcactgaattatgagctggagtnnaagacgtggacgagtggctgtggcatgtatttaagtcaaattgaaggggttcataaaggtgttctctagctggcttctatctataagaaagannnnnnngatttctagtgccgaacttctgtatctattcccaggactcatatcatgnnnnnnnatttcaatttcatcannnnnnnannnnntatnnnnnnnntgnnnnnnnnnnnnnnnnnnnnaatnnntcgtnnnnnnnnnnnnnnnnnnnnnnnnnnnnnnnnnnnnnnnnnnnnnnnnnnnnnnnnna

SEQ ID NO: 1024 - DNA, 632 bp, Zea mays
  misc_feature (288)..(291): n is a, c, g, or t
  misc_feature (314)..(314): n is a, c, g, or t
  misc_feature (482)..(487): n is a, c, g, or t
  misc_feature (489)..(490): n is a, c, g, or t
  misc_feature (496)..(502): n is a, c, g, or t
  misc_feature (522)..(528): n is a, c, g, or t
  misc_feature (530)..(533): n is a, c, g, or t
  misc_feature (549)..(553): n is a, c, g, or t
  misc_feature (561)..(579): n is a, c, g, or t
  misc_feature (581)..(601): n is a, c, g, or t
  misc_feature (603)..(614): n is a, c, g, or t
  misc_feature (616)..(622): n is a, c, g, or t
  misc_feature (624)..(630): n is a, c, g, or t
  unsure (1)..(632): unsure at all n locations
taataatgggccagcaagccttataaaacctgccagtaaacccatccggccccggtgctttatcagatggcagactttgaattgtgttgcacacttcatgttcagaaatgaggtcatccagctctagcagattgaggtctggaatagcagtattctccagagcttcaagattaattaatagagcacaatctgtccctgctcttcccaataagatcataataaaactgatccacagccagggccttatcatcatgggcagtaatatactgtaaatatgtatgtatgtannnnaggtctttggtctatagaagtgnctagatatgttatagaaaaaccaaaatgacttataatttggaactgagggagtaaaagttttcattctgtttgacctgctgtgttcatgagttgctggattctgttccttttcagactggaaatacagtcgcggtaaagcgaatccggataggaaaggacaagaaggnnnnnntnnacttcnnnnnnntgagggaaattaaactactnnnnnnncnnnnagatcctaatattatnnnnntgattgannnnnnnnnnnnnnnnnnnannnnnnnnnnnnnnnnnnnnntnnnnnnnnnnnntnnnnnnncnnnnnnnaa

SEQ ID NO: 1025 - DNA, 607 bp, Zea mays
  misc_feature (187)..(187): n is a, c, g, or t
  misc_feature (204)..(204): n is a, c, g, or t
  misc_feature (540)..(542): n is a, c, g, or t
  misc_feature (559)..(560): n is a, c, g, or t
  misc_feature (564)..(564): n is a, c, g, or t
  misc_feature (566)..(570): n is a, c, g, or t
  misc_feature (573)..(574): n is a, c, g, or t
  misc_feature (577)..(595): n is a, c, g, or t
  misc_feature (597)..(605): n is a, c, g, or t
  unsure (1)..(607): unsure at all n locations
ctctttcccgtttcctacgctgcaaccaaaatattgtgtctccaaacaggtattggattgaattgatgtaaaatatactatagtagtatcatggcattcggaaaactgtgatattataaaccgtggttttaaaaaaacagtgttctcaaacaggccctgggatgtatcatagagatatgctatgcgnaggctttcttttgtatnagttgatagatattactttgaggagagatcctctgtttcacttgtttattttcttaaactgtttcaccttttaagatctatggtcatgggtcatggcgcaccatactcatagagcttatgtggaattattatggccaaaaaatataaaaaagatggaatttgtgacataggattgattaagagtgcaaatactatgtctgtttattaattgcctgaatgtgtatgaaccatgggatttttatggagttctgactcgattccttgtgtttaatgttaggtaccctaatgacagttttgatcgctattggcagccatttccagacgacaagcatgctnnnagtagcacccaaaatgnnacancnnnnnacnnctnnnnnnnnnnnnnnnnnnntnnnnnnnnnac

SEQ ID NO: 1026 - DNA, 735 bp, Zea mays
  misc_feature (2)..(9): n is a, c, g, or t
  misc_feature (35)..(35): n is a, c, g, or t
  misc_feature (122)..(122): n is a, c, g, or t
  misc_feature (570)..(570): n is a, c, g, or t
  misc_feature (643)..(649): n is a, c, g, or t
  misc_feature (655)..(659): n is a, c, g, or t
  misc_feature (670)..(670): n is a, c, g, or t
  misc_feature (672)..(672): n is a, c, g, or t
  misc_feature (676)..(679): n is a, c, g, or t
  misc_feature (681)..(681): n is a, c, g, or t
  misc_feature (686)..(692): n is a, c, g, or t
  misc_feature (695)..(696): n is a, c, g, or t
  misc_feature (698)..(702): n is a, c, g, or t
  misc_feature (704)..(704): n is a, c, g, or t
  misc_feature (715)..(719): n is a, c, g, or t
  misc_feature (721)..(723): n is a, c, g, or t
  misc_feature (730)..(730): n is a, c, g, or t
  misc_feature (733)..(734): n is a, c, g, or t
  unsure (1)..(735): unsure at all n locations
cnnnnnnnntggacagacattcggtctgcaccaanaattttgtgtgctataatgctagcacatagatcacattcaaaattgtagtggtgataagagaattgaagtaactaacagaaaaaatnttataacatgctagtctccttttcaatggcttgctcaaaccattggcatactcccaacagagagatactgtaagaagtaaatcctaataaattggacagatattgtgaattagggagcacattagtaagatcatatatgctattggacttgcagagatatgttatatcattccgctatatgcataataataaacttgaaatgcatactgatacaaagtaaggaccaaaatacatcatataacattaactaatgtcacaagtttacatctactgtcaacttcttgtgttcttcaagcatgcgacacatattgacatatgtacttgtcagaatagatgtgcagcaattcaaagcatgaaaacacgactaaattgaagatcatgaacactctatgctggttctgataatttgtttcaacatgaaaaaaatcatgtcaaattgaaaaggagnataacaagctataagcacaaagtgatgaaattaactcacatttcacgcaatgtattgattgtacccaatgtcnnnnnnnccgatnnnnntagctgatttncntgcnnnngnctacnnnnnnnacnntnnnnnangtaatgtacannnnncnnncacacanacnnc

SEQ ID NO: 1027 - DNA, 669 bp, Zea mays
  misc_feature (444)..(445): n is a, c, g, or t
  misc_feature (449)..(455): n is a, c, g, or t
  misc_feature (462)..(462): n is a, c, g, or t
  misc_feature (480)..(480): n is a, c, g, or t
  misc_feature (484)..(488): n is a, c, g, or t
  misc_feature (490)..(492): n is a, c, g, or t
  misc_feature (494)..(495): n is a, c, g, or t
  misc_feature (497)..(506): n is a, c, g, or t
  misc_feature (522)..(523): n is a, c, g, or t
  misc_feature (532)..(533): n is a, c, g, or t
  misc_feature (535)..(535): n is a, c, g, or t
  misc_feature (546)..(620): n is a, c, g, or t
  misc_feature (622)..(622): n is a, c, g, or t
  misc_feature (624)..(663): n is a, c, g, or t
  misc_feature (665)..(667): n is a, c, g, or t
  unsure (1)..(669): unsure at all n locations
tctttatcctcaccatgagaatgtttacctgatgaagataaaccatactttcccatgccaggagaaatgcaactgcgcttctgaatgtttttcagagtctcactggcaggactacttttgcttatttcaaactcagagggttgatgcttcatcacagggccattggattctttcttcattttctttgatgctcgcaggttatcatgatcaacccctacactgcttctcattcgacgtgattgatcttttccaacaatttctcctaaagaaatgtgaatctttagaaacaaaacaacagaaaggtattagtaaacttcaacaacacttaggtggtgcacctttatctgatgattccaccagcttccttttttccttcagtttagagaagtttctacttgaaggagcatgcagattctttgagggctttgacataccagttagtcnncgannnnnnnccagctnctgtactcatacttgtgntttnnnnnannntnngnnnnnnnnnnttttaaaaagaaaatnnagaaagtanntnatcgtgagagnnnnnnnnnnnnnnnnnnnnnnnnnnnnnnnnnnnnnnnnnnnnnnnnnnnnnnnnnnnnnnnnnnnnnnnnnnnangnnnnnnnnnnnnnnnnnnnnnnnnnnnnnnnnnnnnnnnntnnngc

SEQ ID NO: 1028 - DNA, 1006 bp, Zea mays
  misc_feature (518)..(518): n is a, c, g, or t
  misc_feature (569)..(569): n is a, c, g, or t
  misc_feature (895)..(895): n is a, c, g, or t
  unsure (1)..(1006): unsure at all n locations
cactacgtacgttgtttccaatggccagcgatgatgctttggatcttctgtcaaaaatgcttacctatgatccaaaagcaagaatcagtgctcagcaggctctagaacacaggtgcaacaatgtgactgattggaaactctgttacgttctcttccttgtatggatgacaaatgtttatgttttgttttaaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacaggtaaacancactagccttgctgagtaaagcttgtactatttatatgaacagaacaggtnaaaaacatagtgccttgttggtgtacttagctctcctgttgtgggaaataattgaacatgtcaacctcctgttttgcagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggnaggctcttgaaaacagtagactcaatgggatattcatgagtggagagtgttatggggaattggaggatggaaaagcttgctccatgcgtgtttgtacgtgtttatcaaggt

SEQ ID NO: 1029 - DNA, 649 bp, Zea mays
ccacaaactcatattactcgatacttggcactaaactcagccatatggtaaaatctcgatgaatttgctaatcttcgcagaagccggtgcatcaatcgaaaccaccactaagccagtagatctgtaggtacacgaagagggaagggcaagcaataagctactgctacaagactagatccacacaatttccagcttaatacgaacctgtcgagcccaagaaccctaccagatcttgccctccgccgcctcaaaccccagatccgggtccgccaaggaatgacagcagcccttgggccgcgctggtgccggggggcgcgttgggctcgtcgaggaagaggtcctccggcacccggaacgcgccgtgcgccgcgacgagggccccgccgacgagcagcccggagatgatgagcgacgcgacggaggtgaagaaaagcaggatgaaggacgcgccgacgagccccagcagcgtctcgcggtcggaaaaggttcggccgaagaggacaacaggctggtcggaggggcggaagaggtagaggaagcaccaggcggcgaggaggcccaggaggatgaggagcgagaaggggtgcgccaggagcgaggcccccagcgcgaaggcgaccacggcggcgtagttgacgcggaagtaagc

SEQ ID NO: 1030 - DNA, 719 bp, Zea mays
  misc_feature (165)..(165): n is a, c, g, or t
  misc_feature (237)..(244): n is a, c, g, or t
  misc_feature (528)..(529): n is a, c, g, or t
  misc_feature (557)..(558): n is a, c, g, or t
  misc_feature (629)..(632): n is a, c, g, or t
  misc_feature (634)..(635): n is a, c, g, or t
  misc_feature (638)..(639): n is a, c, g, or t
  misc_feature (665)..(676): n is a, c, g, or t
  misc_feature (679)..(685): n is a, c, g, or t
  misc_feature (690)..(694): n is a, c, g, or t
  misc_feature (696)..(704): n is a, c, g, or t
  misc_feature (708)..(710): n is a, c, g, or t
  misc_feature (712)..(712): n is a, c, g, or t
  misc_feature (714)..(718): n is a, c, g, or t
  unsure (1)..(719): unsure at all n locations
gcgctgcgcggcatggaatgatttgccaaattgaaatcacgacaacatgcctacgatgcaaactgggcattcgtggctgacgagccccttactgaccgggatcggagttaataatgatgcaatcgagaacgagtcctcagcattgctgtgatcttccagtttctnatccttgcacgtgcacgctaattttattcatggacggatcatgggtaggggaaaaaggcaattaggtatggnnnnnnnntggccccattgcagcagattctcagcattgctgtgatctttgagtttaccatccttgcacgtgcatgctaattattcatgaacgaatatgacaggggaatggtgcctgccaggcaattattcatgaacgaatatgctaattctcagcataagcaggaaaaaacgccaagtaggtatggtgcctgccaggctgttgaaccaagttggcgttcgcatatgacaggggagaacaagcagcgttaagcttttgatgcagctcctgtgtcctactgcaaatagaccaanngcatgtttgtttatgataataatatgtnnagattgtataatttaacttatcttaaattaagtgttagtttaaaattagctagactatataacatgtgtannnnannatnncaaacaaacacccctactactactannnnnnnnnnnnacnnnnnnnatgtnnnnnannnnnnnnnctannnantnnnnna

SEQ ID NO: 1031 - DNA, 862 bp, Zea mays
  misc_feature (67)..(67): n is a, c, g, or t
  misc_feature (71)..(72): n is a, c, g, or t
  misc_feature (592)..(600): n is a, c, g, or t
  misc_feature (603)..(603): n is a, c, g, or t
  misc_feature (605)..(606): n is a, c, g, or t
  misc_feature (617)..(618): n is a, c, g, or t
  misc_feature (785)..(785): n is a, c, g, or t
  misc_feature (821)..(821): n is a, c, g, or t
  misc_feature (826)..(826): n is a, c, g, or t
  misc_feature (837)..(840): n is a, c, g, or t
  misc_feature (842)..(842): n is a, c, g, or t
  misc_feature (848)..(848): n is a, c, g, or t
  unsure (1)..(862): unsure at all n locations
ttctaaggttcagcactcgttctcctcctgcatcattgctgatcggttcatcagcatcgtataaacntgtnntgctttgttcccgtcgacgtcaggctgcctgtggccttaccgagaagccaaaggagcccatcgaggacattgacaagttcgacggcgacaaccagcttgctttggtggactacgttgaggacatctacacattctacaagaccgcccaggtaactgcgggttcatcttcagcaagccatgttctgaagcaagcctgatcatcaccatacaccatgtctgcgtcttgtgcagcatgagagccgccccattgactacatgggcaaccagcccgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaggccaaagcccaaattaaagcgctccgttcatatcnnnnnnnnngancnntgaaaaaaaanncgtctgtcgcgcaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgcngatgaacaggtaaagattgagctgctgttctgttcntacangtcttctgtcnnnntnctgtcntcattctgaacacc

SEQ ID NO: 1032 - DNA, 1302 bp, Zea mays
  misc_feature (3)..(9): n is a, c, g, or t
  misc_feature (14)..(18): n is a, c, g, or t
  misc_feature (81)..(87): n is a, c, g, or t
  misc_feature (90)..(90): n is a, c, g, or t
  misc_feature (93)..(93): n is a, c, g, or t
  misc_feature (100)..(102): n is a, c, g, or t
  misc_feature (105)..(106): n is a, c, g, or t
  misc_feature (108)..(110): n is a, c, g, or t
  misc_feature (112)..(112): n is a, c, g, or t
  misc_feature (124)..(126): n is a, c, g, or t
  misc_feature (129)..(129): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (143)..(143): n is a, c, g, or t
  misc_feature (147)..(147): n is a, c, g, or t
  misc_feature (152)..(152): n is a, c, g, or t
  misc_feature (313)..(313): n is a, c, g, or t
  misc_feature (353)..(353): n is a, c, g, or t
  misc_feature (355)..(355): n is a, c, g, or t
  misc_feature (378)..(378): n is a, c, g, or t
  misc_feature (1159)..(1161): n is a, c, g, or t
  misc_feature (1174)..(1174): n is a, c, g, or t
  misc_feature (1232)..(1234): n is a, c, g, or t
  misc_feature (1262)..(1266): n is a, c, g, or t
  misc_feature (1279)..(1282): n is a, c, g, or t
  misc_feature (1289)..(1295): n is a, c, g, or t
  unsure (1)..(1302): unsure at all n locations
ggnnnnnnnaaatnnnnntcctaaatggactgggttactgcctaaatctggaaagatggttagtgcttgaattctttatannnnnnntanggncttacannnttnnannnanactttttattcnnngtnatggtnttnacnancatnagaancgtgtaaccatgaaatattattcttggtgctctaggtaattaatacagagtgggggagcttcaaatccaacaaacttcctctttcagaatatgacaaagccatggactttgaaagtttgaaccctggagagcaggtattgttgctctggcggttgactttnccatttcaggtgactgcatgaatatatgtggataacttangngtggcttctgacagatatacganaaaatgatttctggtatgtatctcggagagattgttcgaagaattttactgaagttagcacatgaagcttctctatttggggatgttgttccacctaagctggagctgccatttatattgaggtatgctttcttgtcctatggacatccagctgttcaagcttgtttgctacattgttggtatggaaaagttgtttatgtctctttaataggctaagttagatgtcacatcagtaagtaatccaaagaaggcgacatgatacaatattttttttggtcaactctgtttatttcaattggttgcaataaacatggtctctgatatgctgcaattttacttttgaataactatcttgatggcatgagaaaatgtgtgcctagaaacagcttgcttcagggagctttatattagattagatttcagggctaataaagtatttacctggagctaaaacaaacggtcaccttgtaactctcgttagtctattaacaggtacatgtattgggtttgaggcatgttgatgcttaacatctttgtgtgatgcttaacattttctttggcaccagctctttctgtgccctttttatgcttattagtaagttgaaacctatgtatcaattagtacatgttcgatgaatacattcgttgtggtatcacaggacgccagatatgtcagccatgcatcatgactcctcacatgacctcaaaactcttggagctaaactgaaggacatagtcggggtacggcttgcctgtgccaaattggcttgttgttcataannngtcagtcagtgtnctctcggtcccttacggcatatacatttgttctcatgttcaggtcgcggacacttccnnnaagtaaggtacatcactcgtcacatctnnnnncttgtcgcagagnnnncagcacnnnnnnncgccgca

SEQ ID NO: 1033 - DNA, 1024 bp, Zea mays
ggtcaaatgcagatatgtggagcatgcaaatgcaattcctaaatggactgggttactgcctaaatctggaaagatggttagtgcttgaattctttataaccatcgtatggtcttacaccattagacacacactttttattctctgttatggtcttcactaccattagaaccgtgtaaccatgaaatattattcttggtgctctaggtaattaatacagagtgggggagcttcaaatccaacaaacttcctctttcagaatatgacaaagccatggactttgaaagtttgaaccctggagagcaggtattgttgctctggcggttgactttaccatttcaggtgactgcatgaatatatgtggataacttatgcgtggcttctgacagatatacgagaaaatgatttctggtatgtatctcggagagattgttcgaagaattttactgaagttggcacatgaagcttctctatttggggatgttgttccacctaagctggagctgccatttatattgaggtatgctttcttgtcctatggacatccagctgttcaagcttgtttgctacattgttggtatggaaaagttgtttatgtctctttaataggctaagttagatgtcacatcagtaagtaatccaaagaaggcgacatgatacaatattttttttggtcaactctgtttatttcaattggttgcaataaacatggtctctgatatgctgcaattttacttttgaataactatcttgatggcatgagaaaatgtgtgcctagaaacagcttgcttcagggagctttatattagattagatttcagggctaataaagtatttacctggagctaaaacaaacggtcaccttgtaactctcgttagtctattaacaggtacatgtattgggtttgaggcatgttgatgcttaacatctttgtgtgatgcttaacattttctttggcaccagctctttctgtgccctttttatgcttattagtaagttgaaacctatgtatcaattagtacatg

SEQ ID NO: 1034 - DNA, 768 bp, Zea mays
  misc_feature (290)..(290): n is a, c, g, or t
  misc_feature (596)..(598): n is a, c, g, or t
  misc_feature (641)..(642): n is a, c, g, or t
  misc_feature (647)..(649): n is a, c, g, or t
  misc_feature (653)..(654): n is a, c, g, or t
  misc_feature (656)..(662): n is a, c, g, or t
  misc_feature (665)..(674): n is a, c, g, or t
  misc_feature (679)..(679): n is a, c, g, or t
  misc_feature (691)..(693): n is a, c, g, or t
  misc_feature (695)..(695): n is a, c, g, or t
  misc_feature (723)..(724): n is a, c, g, or t
  misc_feature (731)..(735): n is a, c, g, or t
  misc_feature (738)..(738): n is a, c, g, or t
  misc_feature (747)..(751): n is a, c, g, or t
  misc_feature (759)..(759): n is a, c, g, or t
  unsure (1)..(768): unsure at all n locations
ctgatacaggtagctcaaaaaacacaccaggaacatgcttaaataatgctgcaaaagggaatgacaagttgatcagaggcagcagcaagctacctgatacatatagttcacaaaacacaccaggaacatgcctacatactgctgtaaaagggagtggcaagttgatcagcggcagcagcaagctacctgatacagatccactggagtcaccttgcagcaactttactgaggtcgacatgattgtctcaccttcaccacttgtctcatggaacactggatcttgtatagtngagagcggaaagcagttgtttctcttgacaccactgccaaaaacaaaagcatgctcatcaaggtgccaaacatcaaaaacccagatgaagacagtttctagcactgaccaattgaacaatcttctaaggcctgtttcaaagctaaccatttctgataataatcatcctgatctagagcaaagtgtgaaggtaaaggaatcatggactagcactacgacacctcatgttgctctagcaaacaaggcctcactagaagacaagctctgttcgcctcgtactttctcagttcagaagagcagaacactnnntagatcatgcctgaagacagcattatctagcaagcagcagctnntctcnnnaatnncnnnnnnnagnnnnnnnnnngacantgacagcaatgnnncnattggggatgacaaatgctcatctgatnnaatctcnnnnnatntagcatcannnnntgatattnatgggctta

SEQ ID NO: 1035 - DNA, 579 bp, Zea mays
  misc_feature (534)..(535): n is a, c, g, or t
  misc_feature (562)..(569): n is a, c, g, or t
  misc_feature (578)..(578): n is a, c, g, or t
  unsure (1)..(579): unsure at all n locations
tgcctgcagcattggctgtgaacctaccaaccacgtggtcttctcttgtcttttctgtcagcgttagtgcctgtacaaaataatattatgttacgagtccagggtgcagagcatcatccagcatttcagctacgtgttgctttccttctaaaatttagacaagtgggttgttgaagagggttttttaatgcactagatctaatagttattgactaaaattaattgagacatctaaacattctagctaatagttcagttattagctattttttataaattattagttaatagtaggtagctatttatcagctagctaattctattaacaatttttaaccaactaactattagttctatgcatttaaacaccctctaagttaaactggagaacaaaagccgttgttttgtcgtggtcaacgaatgcttcatccgaccttgtggtcatgaaagctttaaatcctcaactggccttctcaagtaagagacagacatcgcatctgcatatatggttgagatctgagatgcatgcacgtnntgaggtacatgtgctgcatctgttctnnnnnnnntctgaaatnt

SEQ ID NO: 1036 - DNA, 1108 bp, Zea mays
  misc_feature (17)..(18): n is a, c, g, or t
  misc_feature (93)..(93): n is a, c, g, or t
  misc_feature (111)..(111): n is a, c, g, or t
  misc_feature (117)..(118): n is a, c, g, or t
  misc_feature (204)..(204): n is a, c, g, or t
  misc_feature (299)..(299): n is a, c, g, or t
  misc_feature (310)..(311): n is a, c, g, or t
  misc_feature (326)..(326): n is a, c, g, or t
  misc_feature (397)..(399): n is a, c, g, or t
  misc_feature (409)..(409): n is a, c, g, or t
  misc_feature (544)..(544): n is a, c, g, or t
  misc_feature (564)..(564): n is a, c, g, or t
  misc_feature (574)..(575): n is a, c, g, or t
  misc_feature (616)..(616): n is a, c, g, or t
  misc_feature (677)..(677): n is a, c, g, or t
  unsure (1)..(1108): unsure at all n locations
aggatcggaacctcatnnaaaaatgaagaccaaagtatattaacatgttaacaatattgtaaggtcaccttatcaaggctcagtaataaatgnacagcataaaaagctttnctaatnntcctatggctgcctaatagagaagaccatttcagttccctgatttttcctcacccatacaagtttccaatatacgaagattttaanacaatggaatgtaagatcttttgcctggacgctcatacaatttcatatctaaacaatagataggctcatcacaagggatatcagaagcaacaaantcacaacattnnatgagtacaatggantgggatacaacagtatcactaatataggctttccctgactgggtcagtggcagcaatttttcagacagaannnctcaacaccntgtatgtagattctcttctttaatgaactctactggttatcttcttgaagaaaaaataacctagtttaatttacctgcatacgtgtcacaagaacccatattggattggttagaagaacattgattgacctacancaaaagaaaatgaccatgancatgccgaannatcaagattattaactcaaactaaaaccatgtggtacacantattgaaaactatgcttttctggtgtccaacttagaaaatcatataaattcagcacagctnccataaaagtacactaaatccacccgtccgctttaatttgttccaacaattaaataaaaaaagtgcatgagtagtagtagtaggtaggtaggttacccagcaacagctgcaataccaagccaagaaagcatcccgacagtaccatccccaaggcccttcttgctacgagcaaccgctatatcttccaccttgttcttgaggatctggtagaagtagtaatagattccctggaaccacgaaatggaatgtaactcaaagttcacaagtaccatttactgggtatccacattctgccatccatacatattgcagctcctttgttatcaaaaaccagttaaagtagaagtagaatttaacctgcgacgcggcagtgccgatgagagagggcttgaggccgctgtacaacccactccatccttcggtttgaatca

SEQ ID NO: 1037 - DNA, 694 bp, Zea mays
  misc_feature (26)..(26): n is a, c, g, or t
  misc_feature (589)..(591): n is a, c, g, or t
  misc_feature (593)..(593): n is a, c, g, or t
  misc_feature (600)..(601): n is a, c, g, or t
  misc_feature (604)..(604): n is a, c, g, or t
  misc_feature (636)..(637): n is a, c, g, or t
  misc_feature (658)..(668): n is a, c, g, or t
  misc_feature (672)..(674): n is a, c, g, or t
  misc_feature (677)..(682): n is a, c, g, or t
  misc_feature (689)..(689): n is a, c, g, or t
  unsure (1)..(694): unsure at all n locations
cctagtattccagaggtgatttctcntcattgacagagagcaaatctggttcgtgatccctagtaccagagagggacacggttttcctatcgatgtgttagagtcaagtactcaagcttttgtggttccaatggagtctaagcgtgtgagtgatcaggatgctttgatcgacctggagagtggcaatggcactacagtaagcaactacaccaatggtggggatgctagtttcacagtggggcaagcaagaacagcgcctaatggtgcgtggaatggttgtgtgtgtgccaacgggtgtccgagggacgacaggaatcagcacatggattgctcccctcctgcttcggatgctgttgctagaagtggagatgacaggaagtctgagggggaggagaagcttatggacagctcaggaggggagaagacgaagaagaagcggtccaagaagccaccgcggccgccaaggccgctgacacctacgccgttggatgtttctgaccagaagctcctcaacgaactgagtgagcttgcggtgttgaaacgggcaaggattgagcggatgaaggctttgaagaagatgaagaatgcnnngnaagggtnntcnggtggcaatttgtgccccctgatcattaccannatcttctgcatcgtcatactnnnnnnnnnnntatnnntcnnnnnnctactantgata

SEQ ID NO: 1038 - DNA, 600 bp, Zea mays
  misc_feature (505)..(505): n is a, c, g, or t
  misc_feature (534)..(534): n is a, c, g, or t
  unsure (1)..(600): unsure at all n locations
caggccttaccctcagcgactacaggagatatagcaccagcttctgaaggaactgtttttgcattatgaactggagctgtttcaatttccatcatatcagcacttttgacatcatcatactgcaccacaggtaccttaggagaaccaatgagctcccctggttcttttatcatatcagatgtatcacagatctccacacttccaggaaccttggatgtcccactagagggtgaaagattttctgtatgcgtcacccctgtgggagaaccttcaagagtagttgcagcctcagtattcacagatttaagttcgccttccaatgaatcaatctcgagttcagtcttttcaatctccttggaaatgctttccttcagtaggagcagcttatatgtactggtcgggccatttgaatccccagaacaagaatcctcgtgctggataagttcaacaagcatgtttccaagggaaataacaggatcatcaccgagctgatctaacttgatcngaaattcattattgaaagttgtgtcatcngcctccaagacatctttagtagagttagtgaccgcatttggcatcatttcacaagatttatcttca

SEQ ID NO: 1039 - DNA, 667 bp, Zea mays
  misc_feature (9)..(9): n is a, c, g, or t
  misc_feature (14)..(17): n is a, c, g, or t
  misc_feature (23)..(23): n is a, c, g, or t
  misc_feature (453)..(453): n is a, c, g, or t
  misc_feature (534)..(534): n is a, c, g, or t
  misc_feature (556)..(560): n is a, c, g, or t
  misc_feature (572)..(585): n is a, c, g, or t
  misc_feature (589)..(607): n is a, c, g, or t
  misc_feature (609)..(617): n is a, c, g, or t
  misc_feature (619)..(625): n is a, c, g, or t
  misc_feature (630)..(631): n is a, c, g, or t
  misc_feature (633)..(640): n is a, c, g, or t
  misc_feature (644)..(653): n is a, c, g, or t
  misc_feature (656)..(665): n is a, c, g, or t
  unsure (1)..(667): unsure at all n locations
gcctgcagnggccnnnnatcatngtggggctcgtcctcatggtcatctccctcatgggcttcgccggcgcctgctaccgccagacctggctgctccgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactgggccaccatcagcgcctgcctccgcgacggccacgcctgcgccggcatgaggcgcctcgcacgggaccccaacactggcatgctcgtgccggagacgtccaccatgttctacggccgcaacctctccccgatccaggtcctcttttcaatccccaacaccggcatgcgcgattcatttngtttccatgcgcggttcaaaaaattcctctgctaagggaagattggatttttcttccagtttttattatattctaccggtncacaaaagtcggggattttgtnnnnnttcagcgtttgnnnnnnnnnnnnnntttnnnnnnnnnnnnnnnnnnngnnnnnnnnnannnnnnntactnntnnnnnnnngggnnnnnnnnnnaannnnnnnnnntt

SEQ ID NO: 1040 - DNA, 550 bp, Zea mays
  misc_feature (505)..(516): n is a, c, g, or t
  misc_feature (521)..(521): n is a, c, g, or t
  misc_feature (523)..(523): n is a, c, g, or t
  misc_feature (525)..(529): n is a, c, g, or t
  misc_feature (535)..(545): n is a, c, g, or t
  unsure (1)..(550): unsure at all n locations
tgagtggtgactggagggggtaaataactggctggaccacgactcaattgaccaatgagtcatgggatgcttactggtaagcgtcttaggtgtactgcgtacagttgagtggtagtatgtagtacatattttcttcaatggaaaaaagggtcactttcttttagagatataattcaaagatccttcatcctttagggctaactcatttttctaagagatttccattttcgcaagagaaagttgattttcccttaggaaatggagttgccaaactagttcttagcgaaaaatatcagtgacatgtttcaccgtcatggaatggaggcagtgcagatctgtttccccatccatgatttgagtcaaaagcgtctgtacttagaggcacctgctacagaattatgcacggaatttcttccggtgatgtaaagcaaagcaattcagggaaccaaagtaacgcagggaaaaaaagattgcttttgaagaaaggtatatgctggaaccgaannnnnnnnnnnnagtcngngnnnnntctagnnnnnnnnnnncaaat

SEQ ID NO: 1041 - DNA, 710 bp, Zea mays
  misc_feature (590)..(590): n is a, c, g, or t
  misc_feature (608)..(608): n is a, c, g, or t
  misc_feature (627)..(628): n is a, c, g, or t
  misc_feature (643)..(644): n is a, c, g, or t
  misc_feature (648)..(650): n is a, c, g, or t
  misc_feature (670)..(672): n is a, c, g, or t
  misc_feature (689)..(698): n is a, c, g, or t
  unsure (1)..(710): unsure at all n locations
gtttgggtctacaaacattgggttgacagatctcgatgtactcttccactgtaaacaacacattttgagacattttaagctttaccatcatagagcaaggaggatcaagtatatatagatgttctgagagcaagagttcctacctggtgtgaaaatgcatatgcaagcgctctttctcttcttatcgccgcctcttgcctgcttatcaggcttgcctcgatttgctccttggattgggtgctgtcatcccagttctcacccatctgatatatcattattcacagacagaatatgtttagttctctcaataatatcttataactatctcaaggctttaagcagattagagctttgagaaggtttgcatactctgaaattctccagttcctgtttaagtaggagctggcgttggagagcctggttctcctcggacatctttgctctcctggaagatatctgtgactgcacccgtgatagagtttgcatgcagcgcagagtgcttgcagattgacgctttactgaattaccctcaaccaatgacttcaatcgaacaaggcctcgcagtgctcgtagtgccctccttgcctacnttatcacaatgaccgaanactctcagcataacattgnnttgtaaaagtaaganncttnnntttttctttccttttttttnnngcaaagtgtaaaagtannnnnnnnnnttactatgaaac

SEQ ID NO: 1042 - DNA, 707 bp, Zea mays
cgacctgcaggtgtgactacctgcaaccatttgacatcagaagtaggaaatacatggcaaataaaaatgaatatgactcaaccagcatgttattaccttaacatctgaaaattctatatggtttgcttcactgacataatttccaggagaactgtgatccagtgatctatcacgaaccccagacagctcacgtgaaacatccaataactcacgaatccggtctgcatagccactgtgaaattacattgaaagtccatacgcatcacaatcatgacggtgcaaagtttaaaactcaaaagcagaagagcataaaatgcatctggaacacaaaaggagcacaggactccaccaaagtattccaaagaagttacaatgttttttgtatgtaagtcaacattctccagctgtgctatgactaaagtatggttcctaccaaaacgatcatagatcaagtattgttcctaccaacgcaatcataaatcaagtatggttcctgccaaaacagtcataaatctgtggcggacatcagtgcaaaactttaatgacactgaaattctcgtatactggaatgtagaaaagccacctacacagcatgcaacaggtcaaattatataaaaaataatgtcataattgggcagaatttgaaaactaaaagggcatattgggagaggatgttaatgatttccagtctccgtcaaagcactaaa

SEQ ID NO: 1043 - DNA, 702 bp, Zea mays
  misc_feature (573)..(573): n is a, c, g, or t
  misc_feature (590)..(597): n is a, c, g, or t
  misc_feature (621)..(625): n is a, c, g, or t
  misc_feature (644)..(644): n is a, c, g, or t
  misc_feature (649)..(659): n is a, c, g, or t
  misc_feature (663)..(664): n is a, c, g, or t
  misc_feature (667)..(668): n is a, c, g, or t
  misc_feature (670)..(671): n is a, c, g, or t
  misc_feature (674)..(675): n is a, c, g, or t
  misc_feature (680)..(681): n is a, c, g, or t
  misc_feature (689)..(701): n is a, c, g, or t
  unsure (1)..(702): unsure at all n locations
ggatgacatcagaagatcagcgctgctattagcgaagacagtattgcccacaggtcacaagaaggtacaacctcttgagtttgccaaggcccctgcttcctataaccaagcagctcaacggggtgtcatggataacttgacagagcttctcacgcagatctccccacaggactttcacaaccaccataatctgtttgtcaaaagaaattcaaaaacctaaaagaaaaaaaagcaacactgagaagaaggaaatggcagataacacgaccagaggcttggtgtgctcacttccttctgggtagctgtagtgttcaggaggtccaaggtttccatgtcgggttttgctccatatttcttcgcgataatagggtcagagaactccgagaggggaatcaacgctattatatttaacacagaaaaaaaggacatagatgttcatgatgttaaatcatgttaggatgaaagtaacaccaacattgaaaatatcttgccctacaatgctatttaatagtgaaaacatgaatagcaagctgagccatatggataactggaattgatcctcaaagcggcagnacacgatgaatgaaacnnnnnnnnaaatctgaatttcattttatgtannnnnaatatatactatgtctgtntatgnnnnnnnnnnntagnntanncnntcnnatgtnnctgcgtgnnnnnnnnnnnnna

SEQ ID NO: 1044 - DNA, 466 bp, Zea mays
tgacgcgctcattatatatccccattgttggattatgtacatgatggatgtcaataatatcatagtgggctacactattttacttgtggataaaacgttagcttctgccagctccgtaagcaagtgtggcaagcgtttgtgcgcctagtctttcattcctaataaccaccctgcttctgctcctgcccatagctattctctctcttgcttgcttgctgtgttgcctttgcctgccttggcctgagactgtaagacttcctgctgtaaggaaccaagcatcagcaagccagtcagtttccatgccctcccttttcgttcttagccatcctgatcccatgctaatatgcaatgcaacaaacagggaggacactacattttgtgccacaagctgctcattgttgtttttatttcttttttgtaaagatcgacactacatacacctcttgtacaacaacattctcagtca

SEQ ID NO: 1045 - DNA, 521 bp, Zea mays
tgttggtgtgcatgatgagactggactatgaggagtgcttgttagtgtggaagatggaccaattaacttgttattatgtttataaggtgctcgcatagtttagatattttagtactgttggggaccagttgaaatactgaaaaaacgacaacaggacaatatggttaaattgttagacccttctctcctgcctgcgaaggttgtagagggaagaaagtgttgcaagggtttttagttattctttgactttgagaacaattgtatgacaagcctgttatttgaatatggtcatttcaccttgttcaaacaaagaattgataaacaaagattgatcaacagttcaaagcacatgggcaagaaaaaaacttaggatacacataaacattgaaggaattatgatcctcagagcataagctttgactttattataccttcgaaggctctctagaggaggaaatgcaacaagcgtgatttcaacgaatggccgacccctgtagcagtcgcacgtttcacttatttag

SEQ ID NO: 1046 - DNA, 801 bp, Zea mays
  misc_feature (7)..(7): n is a, c, g, or t
  misc_feature (9)..(11): n is a, c, g, or t
  misc_feature (52)..(52): n is a, c, g, or t
  misc_feature (242)..(242): n is a, c, g, or t
  misc_feature (295)..(295): n is a, c, g, or t
  misc_feature (323)..(323): n is a, c, g, or t
  misc_feature (364)..(364): n is a, c, g, or t
  misc_feature (423)..(424): n is a, c, g, or t
  misc_feature (474)..(474): n is a, c, g, or t
  misc_feature (535)..(535): n is a, c, g, or t
  misc_feature (585)..(585): n is a, c, g, or t
  unsure (1)..(801): unsure at all n locations
ccgccgncnnntcccgttggaaacggtaaaacctccctcctcctggtccgtntcgccggcgtcgggtccaagcggccgcgcggtttcgccgccggcgccgatctgagcgccgccggcgttgaccccacccgattcgctccgggctgctgctggggcccttcttctcagatgtggagttcctccacctacagattataccgcaactgtttgaggagtcctgatccggactagctaagggctcntgctgtgcacgacctgatactacggattttgcgccttctagaggcatgattcntaaatcggagtcttactgtttaaaccanagtttgctttcgttttgaactgtgggtgaatttccattccngcagaacgtgaagtcggtttaggccaggcctgtttgatccgtgttcatatatgtatatnngttatatgtatggaggatacagaacgctgttgcttgcgatctgattaagnctttttttttgttttgcttgctattctgatttccttttcagagtttggagtaaagaaaccnaccttgcatctgtgttctgtctgtctatgctgctttgctttggattcacnaaaaaataagccttgcatctcactgacttgagataactatgcctaaggacaggagctcccgcgtttcctctcacgagagccgccgggctcgtgcctccccatacttgtcagcgtctcatggacagagcagttcttcacgccggtcacaagagtctcctgcggccgcggcagcgaagcaagctgcagagtgggaggatgttcggtgctcggtctgca

SEQ ID NO: 1047 - DNA, 477 bp, Zea mays
  misc_feature (155)..(155): n is a, c, g, or t
  misc_feature (262)..(262): n is a, c, g, or t
  misc_feature (269)..(270): n is a, c, g, or t
  misc_feature (283)..(285): n is a, c, g, or t
  misc_feature (303)..(303): n is a, c, g, or t
  unsure (1)..(477): unsure at all n locations
gcaccactgatcgaagcacaaaatcgcagccttcagcgactggggaggaagatgcagattatactgccactccttcaacaagaacgagaatgagacgacggcggacgccaggaacgatggggttgggcagtaccatgtacaagcaggcaccactngtgatgcgcttgttggtggcagtcttcccgttcctgggatcatggttcaggctgctctgaattgattgttatatattcgtccacggtggttcgtttatgatttcagnaaaaaanngatatatatatannngtggccagtggcattaancaaaggattatgattgtgaaaaatatataagcgtactgaagaagatcgattggttcaggcagtgtgcctgcagcatcagctctgtactgctgcatccgccattgcgaagggaaagaatcacagcatctgacttgctggtgcatgtgtgaacctttgcttcctcgcgcttgtgca

SEQ ID NO: 1048 - DNA, 519 bp, Zea mays
  misc_feature (42)..(42): n is a, c, g, or t
  misc_feature (126)..(126): n is a, c, g, or t
  misc_feature (208)..(213): n is a, c, g, or t
  misc_feature (518)..(518): n is a, c, g, or t
  unsure (1)..(519): unsure at all n locations
agcttcctcagcctggcacacaacagcctgaccggggacatncctagcgccattgcttccttgcaaaacctccaggtcctcgagctgtcggggaaccagctctcggggcagatcccgtcctcactnttcaacatgtccagcctgctaggcctgtacctctcccggaaccacctctcggggccggtgccagacaaccagagctttaacnnnnnnctccctttgctggaacgcgtgtacctcagcaaaaacgagctcaccggcacggtgccgccaggctttgggacgtgcaagtacctgcagcagctcgttctgccatacaaccgcttcaccggcgggataccgccgtggctgtcaaccctgccggagctgacatggatctccctaggtggcaacgacctctccggcgagatccccgccgtcctgagcaacattaccggcctcaccgtactagacttcaccacgagcaggctgcatggggagatcccgccggagctgggccgcttggcgcaggggtaccna

SEQ ID NO: 1049 - DNA, 550 bp, Zea mays
  misc_feature (187)..(187): n is a, c, g, or t
  misc_feature (460)..(460): n is a, c, g, or t
  unsure (1)..(550): unsure at all n locations
ctagctaatcctgccgtgagtgcaatgcatgcaaagatgacgaagcccgcagccatcgttgttgctgctatcgccgtcctctccgtcagcctgctggctgggtcgtcgtgccttgcccttgcgcggcccagcggcgacttctccatcgtgggctactcagaggaggacctgtcgtcgcacgagagcntggcggagctgttcgagcgctggctgtcccgccaccgcagggcgtacgccagcctggaggagaagctccggcggttccaggtgttcaaggacaacctgcaccacatcgacgagaccaaccgcaaggtgagcagctactggctgggcctcaacgagttcgccgacctcacgcacgacgagttcaaggccacctacctcggcctacggagcagtgttggcgatggtggtagtggtatcgatgacgacgacgagccggaggaggaggagggctacnagggtgtggacggggcgagcctccccaagtcggtggactggcggagcaagggcgcggtgacgggggtaaagaaccagggccagtgcggca

SEQ ID NO: 1050 - DNA, 542 bp, Zea mays
  misc_feature (126)..(126): n is a, c, g, or t
  misc_feature (135)..(135): n is a, c, g, or t
  misc_feature (137)..(137): n is a, c, g, or t
  misc_feature (269)..(269): n is a, c, g, or t
  misc_feature (482)..(482): n is a, c, g, or t
  misc_feature (524)..(525): n is a, c, g, or t
  misc_feature (527)..(530): n is a, c, g, or t
  misc_feature (532)..(533): n is a, c, g, or t
  misc_feature (539)..(541): n is a, c, g, or t
  unsure (1)..(542): unsure at all n locations
ttctaatgtcctttaacctcctgaaaaaatcatctttcaggctttgtgcctgggtatcaaatattttacggtcttcccatatgtcaatctgtaacgttgagaaaaagaatatatgagatgaaaccnaaaaaaaanantgtcggaaagcgagatataagcccataggttatcatcccaagtgattaacttactatggatctaagacttatatgagtatgcattactttctaacttttccttaaggattcatcagggcaagtgcaagacanaataatgcagaaagcaggataggtgctaacgtgcaagctaatctatactaggtcacactcacacatatctactgatgctaacttgcacaattgcacctcaacagttcactagggcaaatcaaacagtgctttgagaaagcttaacatcagtctttccaaaaggcagcacagaggggaagtatggacagaactaaggaacaaaagaagaaactnatatctaagagggatcacaaaatggtgagaaaagatagtttnntnnnntnnttttannng

SEQ ID NO: 1051 - DNA, 589 bp, Zea mays
  misc_feature (474)..(474): n is a, c, g, or t
  misc_feature (551)..(551): n is a, c, g, or t
  unsure (1)..(589): unsure at all n locations
gaacacccatcagccacacacaaccggatctcaagattgcttctgtcatgtggtggacgagagcaatagtccaaatacaaatagtctctgtatttaataagaatgctgctccaaggacaaaacccatcaggagatccacaatgatacttgaccacaaagcatgcttccgaattgcagctttgtgtgcatattcaacattcacagtggagctgagccgataataattaagtgaagcttagtattttcaataatctgcacttgagcatacgataactactatgtactaaatgtaaatgcacttaaatattcataatacaaagattacatgaaacaacaaaatggaagtgaaccagtaaactctcttttgtatattaaaataaccatgtaagattagtaataacagaatcactatgttattgcctttgtatatgttaatttataaggatagcacaaaatgttatgacaatatgacanaatagatattaaacaacgactaaagttacagtgcagattaagaagttacggatccactgttaatttaccttaaggangcatcttggaagacaattggccagtagagaatttgaca

SEQ ID NO: 1052 - DNA, 706 bp, Zea mays
  misc_feature (48)..(48): n is a, c, g, or t
  misc_feature (115)..(115): n is a, c, g, or t
  misc_feature (694)..(705): n is a, c, g, or t
  unsure (1)..(706): unsure at all n locations
gaagttttcatgtcgtcatcagtatgtcactgtagataccacagcaantttggactgaatatgcatggacttccaaagatgaaaattttgcatgtgcagtacatttttacttacnttcttaatttcttgcaagatagaatgattattcttattttaatctctgcatggagcagtgaggttcctaataatgttggttcttgctgtgtagaggctatgtgataatgatccaggggtaatgggtgcaactctatgccccctctatgacctgatttcggaggaaccaaattcgtacaaggatttggttgttagtttcgttaacatcctcaaacaagttgctgagaggaggcttccgacttcctacgattatcaccaaatgcctgcaccatttattcaggtacttgagttaaattaaacattatttatttgttaggtgctgctaggttgctattgcgagttatgcttcttttatgggtttaagctttcagttgtcaccatgctatccggctatctgccttagattttgtttctgtcatcggcagataaaactattgaagatacttgctgtgcttggcagtggtgataaacaagcaagtggacatatgtacactgtattgggcgacatattcaagaagggtgacactgcgagcaacattggcaatgctatactgtatgaatgcatatgctgcatttcatnnnnnnnnnnnna

SEQ ID NO: 1053 - DNA, 734 bp, Zea mays
aaaagcaccaatctccacctaaataatacactagctttttctttgaaatactaacgtatcaagatcatgcgtactggcggaaccaaacaccatatataccacgccccaaaacataaaccgaatctgcaatttccagaatatctgcatgtatggcacaagaagagcagtacaccttttttgtacaaaaacacacaaaaaaaaaacagctacaaacgatttttcggcaaacaattctcatctttccggctgttacattttgattctattacaccaaaccaggttgactagtacaaggacagaatgcaaatatcagttgacactttttgggattcaggcccacaaaatttgtcaagaaaatgatgtccaagaatcgtgtcagagaaaatacagtgaatcttacgtatccgaagctttgttccttcctatctatggtaaacacaacatgctactaagtgcagcgatacatccctatggagttcgcagcgtagaatgtatcacatgaatacatgatggcgaagtagccagcactttctatcctcaggttctatctgtctcgaactctcttcgaatggtttctagcaacatctcattccatgtgtctactggtcctggcatgcaccagtgcaaacaatcctgaggtggaggttttccatctggccctctctgtgtcttcttgtttgggtcaggacttctgtacgggccaggatgaccgtcagccctgaaggcaaagggtt

SEQ ID NO: 1054 - DNA, 741 bp, Zea mays
  misc_feature (602)..(602): n is a, c, g, or t
  misc_feature (604)..(604): n is a, c, g, or t
  misc_feature (614)..(616): n is a, c, g, or t
  misc_feature (634)..(635): n is a, c, g, or t
  misc_feature (637)..(637): n is a, c, g, or t
  misc_feature (639)..(643): n is a, c, g, or t
  misc_feature (645)..(645): n is a, c, g, or t
  misc_feature (704)..(704): n is a, c, g, or t
  misc_feature (713)..(717): n is a, c, g, or t
  misc_feature (720)..(726): n is a, c, g, or t
  misc_feature (730)..(731): n is a, c, g, or t
  misc_feature (733)..(740): n is a, c, g, or t
  unsure (1)..(741): unsure at all n locations
tgcattctagttgtgcattagcatattcggtcctgatagactccagcgccagctgttttacaaataggattaatataaggattctaacagtatatgaagatagttgttgtaccacagagatgacaaaaagtcaaaaactatatagcaaatagtaatatatggtgctaatctcagaaagtatgcttaactaacagagacgtcattgaaaaatcaaacataacatagctgacctagtgacaattgttttatagcctcatagcaaccagttgctgtgaatttaaaatgagtacaatcttttcagcatacttcagttcatgaccatgtcaaccaccaaaagacaaacacattttgcataccatgtacgagatattgatccaagaactccctggatgtttgataactgaaaaccacataacagatggtagatataactagtttgtttgttactttgtttgagaggttgactttgaagtaaggcaaagttagattagattgggtccattagccatgttaacctcattctccttataaatatagtacctagtgctagggggcttaagtaaagagatagacaaagttattataatctcctgattgaccangntcaagcatgnnnccactgccaacaagagcnntntnnnnntnatcctagccctcgtcttacccgatttcccaatcaagtcatatcaatattgacataacangcaatgcannnnnttnnnnnnnatanngnnnnnnnnt

SEQ ID NO: 1055 - DNA, 558 bp, Zea mays
gaacgtctggagagggtactccgcttggttctgtgtgtcatctgggtgaatcaacctcatgtcccttatcacgatcgtgtgcttgcagttcccctgaaaacgtgcagcagggtatcagaaaacatggttgaatgatctgataactctgttttgctgttggcacggtaaggctgcgccatgaataatgcagtgcagctgaagctagtaatgagcaaacatcaataatcatccgcattgcagttcagataatgaatgttagattccatcaaaagcatagcataagaaagcaacgtatgctcccattttacacctttttatctttttattgaaggaaagaaccaagcctgtctggttagcacaatgtgacataaagcaaccctgcccaatgtttttgtatctcatattacgaccgacaaacattcaacttcaacataagatatgacacccaaatgaattctaatataaaagatatgaaaaaacgaaggaaatcaaatccacgcacaaacttttcaccaaggaaaatggaactatctgaaacagtaaggcgaaagagaagac

SEQ ID NO: 1056 - DNA, 607 bp, Zea mays
  misc_feature (320)..(324): n is a, c, g, or t
  misc_feature (326)..(329): n is a, c, g, or t
  misc_feature (331)..(331): n is a, c, g, or t
  misc_feature (337)..(341): n is a, c, g, or t
  misc_feature (356)..(356): n is a, c, g, or t
  misc_feature (363)..(366): n is a, c, g, or t
  misc_feature (379)..(381): n is a, c, g, or t
  misc_feature (391)..(395): n is a, c, g, or t
  misc_feature (398)..(404): n is a, c, g, or t
  misc_feature (406)..(408): n is a, c, g, or t
  misc_feature (419)..(487): n is a, c, g, or t
  misc_feature (489)..(511): n is a, c, g, or t
  misc_feature (514)..(516): n is a, c, g, or t
  misc_feature (523)..(523): n is a, c, g, or t
  misc_feature (525)..(533): n is a, c, g, or t
  misc_feature (535)..(541): n is a, c, g, or t
  misc_feature (544)..(549): n is a, c, g, or t
  misc_feature (551)..(554): n is a, c, g, or t
  misc_feature (557)..(557): n is a, c, g, or t
  misc_feature (559)..(580): n is a, c, g, or t
  misc_feature (585)..(602): n is a, c, g, or t
  unsure (1)..(607): unsure at all n locations
attgcctttgtccattgtgttagtaggagttggtgatggcccctgggacatgatgaaggaatttgatgacaacattcctgctcgagcttttgacaatttccaagtaagttgatgttgaacctaatagctcatgtctatgatgattgatgtcagtaagcatgtttgtgctttttgtatgttgagttattttcccctaacattgagaatttattgcttgtctagtttgtaaatttttcagagataatgtccaaaaacatggcacaatcaaggaaagaggctgcatttgctctttcagcattgatggagataccaccacagtnnnnngnnnncntggaannnnngattttggggtaagntttcttnnnntgaatcatacccnnnttcttgcttnnnnnacnnnnnnntnnnaattgcttacnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnttnnnactattnannnnnnnnntnnnnnnnacnnnnnncnnnnccncnnnnnnnnnnnnnnnnnnnnnnctatnnnnnnnnnnnnnnnnnncatac

SEQ ID NO: 1057 - DNA, 550 bp, Zea mays
  misc_feature (13)..(13): n is a, c, g, or t
  misc_feature (194)..(194): n is a, c, g, or t
  misc_feature (203)..(203): n is a, c, g, or t
  misc_feature (314)..(314): n is a, c, g, or t
  unsure (1)..(550): unsure at all n locations
caggcaggagttncaaaacaacgggatcgcaaagagaagcaactcaatacttgtagtccttgacgtgaaggctctcggtgtcggcggcagcatcacccttgtaggtgccgagggtagcctcggagttggccttgcacctggcgaggaaggccgctctagccttctccacgttctccaccttgccagcccaggcnttgagggtnctcgcctggagggcacggccgaaggagaaggacagggcccatggcttcttggtgctgagcttgttcatggcattgagattcagggtggcctcctcctcgctctgtccaccngagaggaagacaacagcaggcacagcagcagggacggtcctctggagggtacggacggtgtactgggcgatcacctcaggtgtcaccttcttagagtcggagccaggagtcaccatgttgggcttcaggagggtaccctccaggaggacatggtgctcgttgagagccttgtagcaggcagcaaggactgtctcagtgacgtaagcgcagcgatcaatgtcatgagggccatcaca

SEQ ID NO: 1058 - DNA, 1107 bp, Zea mays
  misc_feature (9)..(13): n is a, c, g, or t
  misc_feature (22)..(48): n is a, c, g, or t
  misc_feature (50)..(50): n is a, c, g, or t
  misc_feature (165)..(165): n is a, c, g, or t
  misc_feature (277)..(277): n is a, c, g, or t
  misc_feature (286)..(286): n is a, c, g, or t
  misc_feature (297)..(297): n is a, c, g, or t
  misc_feature (309)..(309): n is a, c, g, or t
  misc_feature (342)..(348): n is a, c, g, or t
  misc_feature (358)..(358): n is a, c, g, or t
  misc_feature (363)..(363): n is a, c, g, or t
  misc_feature (370)..(370): n is a, c, g, or t
  misc_feature (380)..(380): n is a, c, g, or t
  misc_feature (416)..(416): n is a, c, g, or t
  misc_feature (418)..(418): n is a, c, g, or t
  misc_feature (450)..(450): n is a, c, g, or t
  misc_feature (492)..(494): n is a, c, g, or t
  misc_feature (496)..(498): n is a, c, g, or t
  misc_feature (500)..(500): n is a, c, g, or t
  misc_feature (502)..(502): n is a, c, g, or t
  misc_feature (506)..(506): n is a, c, g, or t
  misc_feature (518)..(518): n is a, c, g, or t
  misc_feature (520)..(523): n is a, c, g, or t
  misc_feature (531)..(534): n is a, c, g, or t
  misc_feature (540)..(541): n is a, c, g, or t
  misc_feature (555)..(555): n is a, c, g, or t
  misc_feature (561)..(563): n is a, c, g, or t
  misc_feature (628)..(628): n is a, c, g, or t
  misc_feature (633)..(634): n is a, c, g, or t
  misc_feature (667)..(669): n is a, c, g, or t
  misc_feature (675)..(683): n is a, c, g, or t
  misc_feature (686)..(686): n is a, c, g, or t
  misc_feature (691)..(698): n is a, c, g, or t
  misc_feature (710)..(710): n is a, c, g, or t
  misc_feature (718)..(774): n is a, c, g, or t
  misc_feature (776)..(798): n is a, c, g, or t
  misc_feature (800)..(806): n is a, c, g, or t
  misc_feature (808)..(808): n is a, c, g, or t
  misc_feature (851)..(852): n is a, c, g, or t
  misc_feature (863)..(863): n is a, c, g, or t
  misc_feature (874)..(874): n is a, c, g, or t
  unsure (1)..(1107): unsure at all n locations
tgctcgccnnnnnctctctaannnnnnnnnnnnnnnnnnnnnnnnnnnancgttcacatggctgcgatgccaccggccttcacgggcaacctgaaggtgagtgcttaaaagatccccatctgccattgcccggttcggttcgggtcacactctgccggttccggngcactgcgggcgcggcatcaacaccacccatggccaccacccccatccacaagcgacgtcgcaggtttctacgcgggcgcgttgcgtctccagccgtcttccgccattcaangaatccttngttcctccggnccccatccgccnaccttcaatctcctccggaggggcatggatgannnnnnntttgccgccnagctntgctgantcggggggcnggcgtccgtggcattcagagctccattttgcgcttngnagtagattcagttctctgcagtcaatagctcnaacactcctggacatggatattgggttaacgtgactgcgaannntnnngnanccanaaatacaacctntnnnngattattnnnngctaannactataggcgggantatcannngggttcaaatatttggacttatgtgctcctttgaggcggcgaggcagccacacccacacgcagtngcctnnggcgcctgggcggtgagtccgcctatgactgcnnntgttannnnnnnnntgngcatnnnnnnnnttgattgaattngttgtagnnnnnnnnnnnnnnnnnnnnnnnnnnnnnnnnnnnnnnnnnnnnnnnnnnnnnnnnnannnnnnnnnnnnnnnnnnnnnnntnnnnnnngnggcagacattagtggcttgaagtgcagccaaacggcttaggtnnatctatctctnctgagatatgnaatgggacattgtaggtttatgcatattcagccacctttgctagttattatgtgattttgtaaatttcctgagcctgcgactaaattatttcaacatatttagtaatgcgctgggagtatatgcagaacttaagtaccttttctgtttgttttgtcaacaaagtgagcaaaaaacaatgctttgttatgtgtggccatgttgcatgagtgaagaagcacgtgtttctttcttt

SEQ ID NO: 1059 - DNA, 1469 bp, Zea mays
tacccctccgcctctcggcccggggaagcaaaggatcagatgcccaaaattcccggctcgaagactgcaggcatcggacgcgccccccgccgagaagctactcgaatcccctccaaaattcggaggcgagagccactgatctatcgcaaaacccatcaaattacacaattcaaatcagccaaccccacctacagccaccaattcgtgcgcatcaagtctagccccctaccccttcgcaatcagtgaacccccaatccacacacagcctgcgaatcgctggatcaaaatttggtctcggactctcgatccaccattccccgaggaaggagatctcagtcaaccgaataagtctcgggaagctctgtgttggaaacatggggaaaccgctgatctacgagatactggagaagccggcgagcagcagcgtcatcggcatctgctctctgatctggtggctcatccagaagcggggcatcgggtacgcggacgtcgggctgagctacgaggccgcggtggacggcgggcagtactggcgggtcatcacctccgccttctcgcacgtcagcgtggtccacctggtgttcaacatgagcgcgctgtggagcctcggcgccgtcgagcagctgggccagatcgggctcggcgtccagtactacctgcactacacgctcgtcctcgtcgtgctgtccgggctactggtcctcgggttctaccacgtgatgatccagaggttcaaggtggagtacttcaggagggtcaccgcggtcgggtactcgtgcgtcgtgtttggctggatgacaatcctggccgccaagcaaccgtcgtccaagctgaacatcttcggggttctctcactgcccatcagcttcgcgccgttcgagtcgctgatattcacatccatcatggtgccacaggccagtttcattggccacctgtccgggataattgttgggtactcgattgcctggggtctggtccatgggatgaacaactactgggcagtcaccatgcttggctggactgcacttgtgtttgtcttgagcttgaagcgcacagggtctatggagctgagttttattgagatcgagccagtgacggacccctcgctgccttctgttggtgtggtagccaccagaaatggtagaagtagaactctgcaaatggatgccttgtctggaagaagagttgcagacattgtataacacgcagagaggaaatgtttgaggaatcctgagtttttgttctgaaaactgtatcatgtcgacacaatgatacgtattgggtttggaattctggtgtcgctgatgtctttggtcattgctggtgtaaaggaattcttcgtcttggccttccagatgcatgttcattttgaatagaaatgaattctttgcgctagttgcctagttaccatgtaatgtaaagagattttttttccagtttaactggattccttcagtgctgccctcttc

SEQ ID NO: 1060 - DNA, 701 bp, Zea mays
  misc_feature (112)..(115): n is a, c, g, or t
  misc_feature (157)..(157): n is a, c, g, or t
  misc_feature (500)..(500): n is a, c, g, or t
  misc_feature (583)..(585): n is a, c, g, or t
  misc_feature (587)..(587): n is a, c, g, or t
  misc_feature (605)..(606): n is a, c, g, or t
  misc_feature (611)..(619): n is a, c, g, or t
  misc_feature (623)..(633): n is a, c, g, or t
  misc_feature (646)..(664): n is a, c, g, or t
  misc_feature (668)..(700): n is a, c, g, or t
  unsure (1)..(701): unsure at all n locations
gtacgtgaacgccaccagggatccttggaccgtcctcaacgacttgatccttcggttccttagaacgaggacggtagccagaacgatggcggtgactgcggcgacgaaggannnncccgcgacgacgagcccgatgaccagtttcttggtgttcccnttgctagagaactcggaggcagcgaggcggatcgagatgctgccgcctccggtgccactgccagcgctcgtcgtgtcctgaaggttgatgaggtccccataccacagcgagcagccgccgctgtaggagtaagcggtgcaagagcagttgcggaggcacgcgagctcgcagtcgtgagcgctcgcggccgccgcgctccgcgcgtcgctcggcagcctcacgtcgggcatcgtgtagaacctatcgtcgtccctgcggcgcttctgcccgtctcgagcggcggcgccggcgccgcaaggctggagtgcggtgttcctggcgcatcccgcggtgtggtcgtccngcatccactcggccaggtcgcgctcccggaacccccgggggcaggtgcaggacggcagcgcgttctcggtgcacaggccgaannncncgcacaccgcgtacacgnngcacnnnnnnnnnggcnnnnnnnnnnngagcacccactgnnnnnnnnnnnnnnnnnnncgtnnnnnnnnnnnnnnnnnnnnnnnnnnnnnnnnng

SEQ ID NO: 1061 - DNA, 666 bp, Zea mays
  misc_feature (165)..(165): n is a, c, g, or t
  misc_feature (179)..(179): n is a, c, g, or t
  misc_feature (183)..(183): n is a, c, g, or t
  misc_feature (303)..(303): n is a, c, g, or t
  misc_feature (349)..(349): n is a, c, g, or t
  misc_feature (368)..(368): n is a, c, g, or t
  misc_feature (384)..(384): n is a, c, g, or t
  misc_feature (540)..(544): n is a, c, g, or t
  misc_feature (555)..(557): n is a, c, g, or t
  misc_feature (572)..(572): n is a, c, g, or t
  misc_feature (574)..(574): n is a, c, g, or t
  misc_feature (582)..(582): n is a, c, g, or t
  misc_feature (595)..(596): n is a, c, g, or t
  misc_feature (606)..(607): n is a, c, g, or t
  misc_feature (609)..(629): n is a, c, g, or t
  misc_feature (633)..(639): n is a, c, g, or t
  misc_feature (649)..(655): n is a, c, g, or t
  unsure (1)..(666): unsure at all n locations
caaagtgaactttacttatcaaagtagcggttcaaattgtgccactgaggatccttgcaacaatttccaaagcgaacaacttctgtagaaaacactttcaactcttccctgttggaccaaacaaaaacttcagtaaccaaaaaaggaagacccagcgttggaggnttccacatgagccnggtntgggaaaggaataaatcgaggcaagccttcccccacaaatgtggagaggctgcttcgaacccgtaacctgatgacttagtgagacagctctcaccattgcatcaggtctgcccttctatnaaaaacttcagtaactacaagcatataaaaacaagttggagtacanttttttctatataaccagnttgaaacgacttaaanaaaataaataaatacatagagcatcagagattatttgcgaaccttttgtcagcagcaacaatcttgagtaattcatccatatctttggatataagattctgaacaccttcagagtgcagaaccgtttcttttaagtactttatgctatcttttgannnnncatgcattagnnngcaacctttgactangntattggcnacctcaaatgctnnaatatatatnntnnnnnnnnnnnnnnnnnnnnntgannnnnnnctacttatannnnnnnctgtcatgcta

SEQ ID NO: 1062 - DNA, 995 bp, Zea mays
  misc_feature (148)..(148): n is a, c, g, or t
  misc_feature (247)..(247): n is a, c, g, or t
  misc_feature (439)..(439): n is a, c, g, or t
  unsure (1)..(995): unsure at all n locations
gccggggctggtgatcctgtacggcagcatcgtgaagaagaagtgggccgtgaactcggcgttcatggcgctgtacgcgttcgccgccgtgtggctgtgctgggtcatgtggggctaccagatgtccttcggccagaagctgctcccnttctggggcaaggccggccacacgctcggccagggcttcctcctcagccaggcggggctcccggcgaccacgcacttcttccacggcagcggcgtcgtngagacgggcgagatcacgcccttgtatcccatggcgtccatggtctacttccagtgcgtgttcgccgccatcacgctcatcctgctcgccggctccctgctcggccgcatgaacttcaaggcgtggatgctcttcgtcccgctctggctcaccttctcctacaccatcggcgccttctccatctggggcggnggcttcctcttccactggggcgtcatcgactactccggcggctacgtcatccacctctcctcgggcgtcgcgggcttcaccgccgcctactgggtcgggcccaggctcaccaaggacagggagaggttcccgccaaacaacgtcctgctcatgctcaccggcgccggcatcctgtggatgggctgggccggcttcaacggcggagacccctacgccgccaacatcgactcctccatcgccgtggtcaacaccaacatctgcgccgccaccagcctcctcgtctggacctgcctcgacgtcatcttcttcaagaagccctccgtcatcggcgccgtccagggcatgatcacgggtctcgtctgcatcactcccggcgcaggtacagtacatatacacgattctgtctacaatcactactctactctactactgccagtgccagcctgatgatggttcttgtaggcctggtccagggctgggcggcgatcgtgatgggcatgctctcgggcagcatcccgtggtgcacgatgatggtggtgcacaagcgctcccgcct

SEQ ID NO: 1063 - DNA, 743 bp, Zea mays
acttgtgctccatatttaacacaatagcgtaaatagtgctaattttagcttctaaaacaattaacacaaatagatccaaacatgccgtaatcacgtccaacgttaagcaaacagaaactatgctgaagtgtgcacaagtgacactgaatggtaccaatccagagtgaaccggctagagctacatggcaccaaagtgcttgaacggggagaaaataacgcgaaaccttggccggtggagcagcagaataaccaagcgaagaatgtttactgaacctcgattagggccgcaagaaaatgcggcgaattaatcagcttaaccaaaacctgggaattccagagtcacgttcggctgaaacgctgttgttaggcagcctctgtattctgccagagaactcattaacctaggcaagatataacaaacatacatcaataatggtttcacgtcaacagattagacaattaattccaatgagtaatcactaccgctgctccaaattaaatgcatttctagacaagtacgtctaggtgcattgccaaaaatgaatttatttcggatggatggagtaagactcctgtgcatgaaatcatgaatacatctgacgtcatccaaagaaaaggatgaaatagatcaagtccctctggttttgatcaaaggcaaggatgatatatagatcaagttactcttgttttgctcaaaggcaatcatttgcgaaaagcaggatccgacagaacaatgtgtttta

SEQ ID NO: 1064 - DNA, 448 bp, Zea mays
gatggccaatgcaagcatggtggttctgtggagcgaagtatcccaaaggtgtccagggaagtttcagaagaaccttggcctttaaacgatcttaattccttcaccgctatggatgtaaaggatgatcctgtgcaaacggctccagatacttctcctcgggcaaggcacatcacagatcattgttctattactcaagtcgttgatccaccatacctgtcccgaccagcggcaaagattggtgctttcagaccatattatctaggacacacggaacctacccaacaagaaatgccaggtgctgtcgtcatgtttgactcaactcataaagtctcgactcctgaaagcgaggtattcaagtttgttgatcctatatgctttgctgctgaggtgccagacaaatgtgggtatggttgctgcggcgctcatgagcagcatcgtaagaactcat

SEQ ID NO: 1065 - DNA, 762 bp, Zea mays
atcagcaataagttcgcggtcgcctttctctcctctctgccccagggcgagagacctaagccagaacagcactaccaccaccgccggtatataaagaggctcccttcgtcacccgtaccggattaccaacccaaccgaacctgtaccgggcggcgggcgcaaaaccgcgtggagcaccagcgaggcatcggccgacagcgttgaagctctacctagcgggatgtatttcttcatgtctggtggtataacaagccactgaggagagcgggcacggagcttcgatcgagcagtggcgttgctgcacttgagcgagaaagtgagctgaggctgggagagggagggaggggtcatcacagttcatccatggttgtgcttgtccagaagccgtggctgcccatcgacctgcgtctgccggcggggccgcaggcgtcgctggggatcctggcgttcgaggcggcggcggccatgtccaggctgctgtcgctgcaccggtcattgtcggaccaggaggtctcccggctgcgctccgacgccatgcgctcgccggccgtggcgtacctcaactccaccgaccaggcgttgctcctcaggctggcctgcgccgagctggtcgtgtcgctggacgccgcggccgccgccgtcgcgcgcctcggcctgggggtgcggcctcgatttcggcggccgtgtacgcctgcctcaaggccggcgcccccgacgcgcgccttgatccgctcgtggccaaggggctcagggtcaaggcca

SEQ ID NO: 1066 - DNA, 685 bp, Zea mays
  misc_feature (296)..(296): n is a, c, g, or t
  misc_feature (579)..(581): n is a, c, g, or t
  misc_feature (597)..(598): n is a, c, g, or t
  misc_feature (656)..(658): n is a, c, g, or t
  misc_feature (664)..(670): n is a, c, g, or t
  misc_feature (672)..(674): n is a, c, g, or t
  misc_feature (680)..(684): n is a, c, g, or t
  unsure (1)..(685): unsure at all n locations
tcccggcattcatatgcagatttgccaaatatatggaatggaactgagaagaactcattgtatataaggccacagtatattgagaatattgccatcagaagaataacatatcgtccgccgaatgccaactccataaagctaccaagcttctgaaataagttatgaaccgaaggttacaggaagagattaagtgtgcttgcgcaaacactgtgaaataaatagcaagatgcaaagttcgaattaaggctcctgaaacagacaagcatcactggaagagattaagtgtgtttgtgtanacactgaaataatggcaagaagcaaagttcaaattaaggctcctgaaacagacaagcatcactggagccaaaggggccataaaaaactcttcagtgggtttcctgcatgcttatgtgttttactggattccatttgcattacaggactgattttctgaacttgtgtgtaatcggttatctgccatatttctaaacaggtcctgtgatataacaggttccttttttgcctctgactctatcagaatgaagtataatacgctcaaaaaagattaggagtagattnnntaagaatattctttanncgctaaaattcctttgtgatatttaatacagtataacataatacatatacatgatttnnntctaannnnnnntnnnttatgnnnnng

SEQ ID NO: 1067 - DNA, 693 bp, Zea mays
  misc_feature (570)..(572): n is a, c, g, or t
  misc_feature (601)..(602): n is a, c, g, or t
  misc_feature (606)..(606): n is a, c, g, or t
  misc_feature (628)..(632): n is a, c, g, or t
  misc_feature (646)..(646): n is a, c, g, or t
  misc_feature (648)..(648): n is a, c, g, or t
  misc_feature (660)..(661): n is a, c, g, or t
  misc_feature (663)..(663): n is a, c, g, or t
  misc_feature (665)..(665): n is a, c, g, or t
  misc_feature (667)..(668): n is a, c, g, or t
  unsure (1)..(693): unsure at all n locations
cagagctcggtagaaaatgtggagcgagttacagtccagatcagtcgcagttcaataatctagcctgctcttgctacctcctgccacacagtgatcaagaagtgttggagaaattaaataaagagagcaagacaagtaggcaacactactcccataacttccgttctcttgttaggcctgtttggtagagcgctagagctcctcctgcactcctggatctgtgaggactgagaagtgattctctaagagaagcgattatgttggtgaaattctatgcaaaaggattctgcttgtggagcgaatcaagagaagctacaattttcagctcccagcctcctagttcatttcagatgatcacttcatggaatcagcattgaatcaggtctctgtaaaaaaaaccctgcttggcagaactcctccttgattcagcctagaagctgttctcggaggtctgccaaacaggcccttacattgctgctacactacacataataccaagggcatgtatttcattgatgaaatcaccccaacttgccttacatctgccagtaagcagtcagctagttgagnnncagctcctatacaaagagctaataggacnntggnggatacccttactaatacttcnnnnntattggatattcangntgccatcactgnncngntnntcatggattttcataccctatggga

SEQ ID NO: 1068 - DNA, 479 bp, Zea mays
  misc_feature (158)..(158): n is a, c, g, or t
  misc_feature (164)..(164): n is a, c, g, or t
  misc_feature (180)..(181): n is a, c, g, or t
  misc_feature (183)..(183): n is a, c, g, or t
  misc_feature (201)..(201): n is a, c, g, or t
  misc_feature (210)..(210): n is a, c, g, or t
  unsure (1)..(479): unsure at all n locations
gaggcgagccgggccaccatcgattcgctgctcaccgacgggtccaagctgatggactcgttcagcctcgtggtgaaggagctcgaggagtcgcgtgccaaggtcaaggccctcgaggacgagatcgcggagacgtcgtcgagggccgcaggcgaccnctgcanttgctcgggctcgganncngaggcctccgagctgagngcggagctngaggccgcggaggccaggtaccaagaagagaagatccttagcaccgtcgagacgcagtgcgcgtacgagctcatggaccagataaagacagagtccgacctgcggcacggcaagctcgcggcggcgctcgagggcgccaagtccgaggtcatcttcctcaaggcgagtctgttcgacaaggaatccgagctacgtagtgccctggacgcgatcaagaagctacaagcggagacgagagcagacggctcggccgacgcgctgaagcagca

SEQ ID NO: 1069 - DNA, 614 bp, Zea mays
  misc_feature (325)..(325): n is a, c, g, or t
  misc_feature (328)..(328): n is a, c, g, or t
  misc_feature (331)..(335): n is a, c, g, or t
  misc_feature (349)..(349): n is a, c, g, or t
  misc_feature (357)..(362): n is a, c, g, or t
  misc_feature (389)..(389): n is a, c, g, or t
  misc_feature (548)..(548): n is a, c, g, or t
  misc_feature (563)..(563): n is a, c, g, or t
  misc_feature (584)..(584): n is a, c, g, or t
  misc_feature (612)..(612): n is a, c, g, or t
  unsure (1)..(614): unsure at all n locations
atcaaacctctgaaaagtctagacacgccaagaaatatcttcccttgctccacttcgtcctcctgcagtccatcgccatcccaggttacagcaaattcaaattcatccaggctggaagaagaacacggcacaccaactcgacacctgcaatgcatcatcgatgcgtgaagggaacgacagcagagtcatccgaagacggctgcagcgcgctgatcctgaccacgtagctcttctgcctcgacgcgacgctgctgcggcccgagccggagctcgggcgcgtgtcatccgaggagccgtcaccgccgaagaggctggaggagctggngtnccnnnnntcctcctcctcctncccgtagnnnnnngcgctgccgatgtgccccccgcacttncggcagagcaggcgcgaccgcctcctgaagaggccccaggagcgggcggagcggaagtagggcgtgcaggtgagctcgtgggccagcgtgaaccggctctcgtcgaccgcgacgaaggcgacgacgcccttcctgatctgcttgcggtacttgggcccnatgccctccgtgtcncgcgccgaggagctcaggttnagcgcgtacccgcagtacccgcaggggnat

SEQ ID NO: 1070 - DNA, 515 bp, Zea mays
  misc_feature (21)..(21): n is a, c, g, or t
  misc_feature (31)..(31): n is a, c, g, or t
  misc_feature (85)..(85): n is a, c, g, or t
  misc_feature (89)..(89): n is a, c, g, or t
  misc_feature (103)..(103): n is a, c, g, or t
  misc_feature (109)..(109): n is a, c, g, or t
  misc_feature (112)..(112): n is a, c, g, or t
  misc_feature (120)..(120): n is a, c, g, or t
  misc_feature (126)..(126): n is a, c, g, or t
  misc_feature (139)..(139): n is a, c, g, or t
  misc_feature (142)..(142): n is a, c, g, or t
  misc_feature (427)..(427): n is a, c, g, or t
  unsure (1)..(515): unsure at all n locations
ccagacgctgcctgaatcatnttctagtttnctgttcttgcatacaaaagattgtagtgttttcgtacatatttatccataatancaantcagatacatatanatgctnaangcttcctnctaatntccaagtatttgntgncccctctttgattttgtatgatttattatggactattggtataatgcagctggagttccatcagagaatattctttatcttggcggacctaatattgcttctgaaatttacaacaaagaatatgcaaatgcacgtatttgtggagctgacaaatggagaaagccccttgcaaagtttttgaggcagcctcattttattgtgtgggataacagtgatctcatcactcatgaagtcatgggtggcttaaaaaatgtctatgctattggtgctggtaatttctatttntctttttcactgtttcctgttttcttgattacaatggagagctacatatatcattatattaagaataaaaagatgggctagaaaccct

SEQ ID NO: 1071 - DNA, 515 bp, Zea mays
  misc_feature (88)..(88): n is a, c, g, or t
  misc_feature (373)..(373): n is a, c, g, or t
  misc_feature (376)..(376): n is a, c, g, or t
  misc_feature (389)..(389): n is a, c, g, or t
  misc_feature (395)..(395): n is a, c, g, or t
  misc_feature (403)..(403): n is a, c, g, or t
  misc_feature (406)..(406): n is a, c, g, or t
  misc_feature (412)..(412): n is a, c, g, or t
  misc_feature (428)..(428): n is a, c, g, or t
  misc_feature (430)..(430): n is a, c, g, or t
  misc_feature (484)..(484): n is a, c, g, or t
  misc_feature (494)..(494): n is a, c, g, or t
  unsure (1)..(515): unsure at all n locations
gggtttctagcccatctttttattcttaatataatgatatatgtagctctccagtgtaatcaagaaaacaggaaacagtgaaaaaganaaatagaaattaccagcaccaatagcatagacattttttaagccacccatgacttcatgagtgatgagatcactgttatcccacacaataaaatgaggctgcctcaaaaactttgcaaggggctttctccatttgtcagctccacaaatacgtgcatttgcatattctttgttgtaaatttcagaagcaatattaggtccgccaagataaagaatattctctgatggaactccagctgcattataccaatagtccataataaatcatacaaaatcaaagaggggncancaaatacttgganattagnaggaagcnttnagcatntatatgtatctgattngntattatggataaatatgtacgaaaacactacaatcttttgtatgcaagaacagnaaactagaanatgattcaggcagcgtctggt

SEQ ID NO: 1072 - DNA, 1006 bp, Zea mays
  misc_feature (7)..(7): n is a, c, g, or t
  misc_feature (133)..(133): n is a, c, g, or t
  misc_feature (170)..(170): n is a, c, g, or t
  misc_feature (172)..(172): n is a, c, g, or t
  misc_feature (184)..(184): n is a, c, g, or t
  misc_feature (219)..(219): n is a, c, g, or t
  misc_feature (454)..(454): n is a, c, g, or t
  misc_feature (520)..(520): n is a, c, g, or t
  misc_feature (530)..(530): n is a, c, g, or t
  misc_feature (564)..(564): n is a, c, g, or t
  misc_feature (667)..(667): n is a, c, g, or t
  misc_feature (712)..(712): n is a, c, g, or t
  misc_feature (731)..(731): n is a, c, g, or t
  misc_feature (781)..(781): n is a, c, g, or t
  misc_feature (815)..(815): n is a, c, g, or t
  misc_feature (849)..(849): n is a, c, g, or t
  misc_feature (982)..(984): n is a, c, g, or t
  unsure (1)..(1006): unsure at all n locations
ggcgcancagatctgttggcttctggatgcatgacacttaagctatcctgactaagaagctcataaaacgcatcaactgcagagacaccctgaaatggaacggcaacaggataattcatcacatgattcattnaggcatattcatgcagttctttgaagtttcgttgtcnancaaaattaaaanggcatacctgaatggtcccttttcctttaatactntcacccatttctaatgtcaattcacctttagctaacttctgcccataccatgcattacgacctttcaacaatgtgacataagtgtcagctaataagggtccagcaagtttttcaggttcttcttccagaaggtgtgtgatgtagatcatctcagatgtgcaaagtgcaaagtaaacagatttgctggttgcactctcgttggttagtgcagctaccatacctgcaagatatcagnatgttcagcaaattgatgaaatcataggctacttgggggtgtcactgagcgccaagctatgtgcanagaataaagntcactgcaccatgcatttctcaccacttattgcntattgaatcttcccttataggtgacatcagtaattaagatgctttgacttacattattttgtttccttaagacaacacattcgtaggaagcagggcatcaganaattcaacgaaacaaaacactgactcaagaacattaattcaagtngggaggaaacagtaaaaantatggtggggtggcatgtgtgatgttgcaagggtttctagcccatctttntattcttaatataatgatatatgtagctctccantgtaatcaagaaaacaggaaacagtgaaaaaganaaatagaaattaccagcaccaatagcatagacattttttaagccacccatgacttcatgagtgatgagatcactgttatcccacacaataaaatgaggctgcctcaaaaactttgcaaggggctttctccatnnntcagctccacaaatacgtgcat

SEQ ID NO: 1073 - DNA, 739 bp, Zea mays
  misc_feature (539)..(539): n is a, c, g, or t
  misc_feature (584)..(584): n is a, c, g, or t
  misc_feature (600)..(601): n is a, c, g, or t
  misc_feature (611)..(611): n is a, c, g, or t
  misc_feature (613)..(617): n is a, c, g, or t
  misc_feature (621)..(622): n is a, c, g, or t
  misc_feature (628)..(632): n is a, c, g, or t
  misc_feature (634)..(634): n is a, c, g, or t
  misc_feature (638)..(639): n is a, c, g, or t
  misc_feature (643)..(645): n is a, c, g, or t
  misc_feature (648)..(648): n is a, c, g, or t
  misc_feature (661)..(661): n is a, c, g, or t
  misc_feature (663)..(664): n is a, c, g, or t
  misc_feature (676)..(683): n is a, c, g, or t
  misc_feature (685)..(738): n is a, c, g, or t
  unsure (1)..(739): unsure at all n locations
cgccgacgtcgatgtgcccgacggtgggccgcccgtacccatccaccgctgcatccttgccgcacgcagcgacttcttctacgacctcttcgccgctcgcggccgcgcaggggcagcgcgcggtgatgcggccgccggcgccggagtagccgcggagggggctgccagtggaaggccgcggtacaagatggaggatctcgttcccgccggccgcgtggggcgcgaggccttccaggcgtttctggggtacctgtacaccggcaagctccggccggcaccggtcgacgtggtgtcttgtgctgacccagtgtgccatcacgattcgtgcccgccggccatcaggtccgcggtcgagctcatgtacgcggcgtgtaccttcaagatccccgagctcacctcgctcttccaggtgagacgcaatttggttcttgctcgccccattgtcaataggattaaactctaatttctttaggaattgtttcgttctatgccaatactgtacatggcttcggtagactagaaatggatttgtgattttnttttctccaatccgagtgttgactacatcactacaaaaagctatnaatagctgaactgctnnaattgctgantnnnnnttcnnttttcnnnnntncganngttnnncanatcactgcaaaangnnattaatagctgnnnnnnnncnnnnnnnnnnnnnnnnnnnnnnnnnnnnnnnnnnnnnnnnnnnnnnnnnnnnnna

SEQ ID NO: 1074 - DNA, 687 bp, Zea mays
  misc_feature (43)..(43): n is a, c, g, or t
  misc_feature (53)..(53): n is a, c, g, or t
  misc_feature (171)..(171): n is a, c, g, or t
  misc_feature (207)..(207): n is a, c, g, or t
  misc_feature (226)..(226): n is a, c, g, or t
  misc_feature (228)..(228): n is a, c, g, or t
  misc_feature (237)..(238): n is a, c, g, or t
  misc_feature (299)..(299): n is a, c, g, or t
  misc_feature (332)..(332): n is a, c, g, or t
  misc_feature (360)..(360): n is a, c, g, or t
  misc_feature (414)..(414): n is a, c, g, or t
  misc_feature (445)..(445): n is a, c, g, or t
  misc_feature (657)..(659): n is a, c, g, or t
  misc_feature (661)..(662): n is a, c, g, or t
  misc_feature (669)..(669): n is a, c, g, or t
  misc_feature (674)..(675): n is a, c, g, or t
  misc_feature (680)..(681): n is a, c, g, or t
  unsure (1)..(687): unsure at all n locations
caatacttagaatgttatggtgcagggaaaataatgtagccantaacataaancacaatcttcttataaacgtgaacataagacaaagctcacgacaatgacatatcccaaccccaagttctaaggtgctatttgatcatcatccagtggtgtgaaatcattctcgttatnttatctagaactaggacactactaggttgtgtgcantatggacaggcaagtggcnanttaataatnnaggcttgtcatctgtaattagattaatttgggctttgtgactacaattgtttatttcctanaacatgtacagctttcaccaatttgaaaaaaanggagaaattgatgtggtatggggtgggngttttccttttttccctctttatgagaacaaaaggtcaggcacatgtcattagnctacaagctagcctgaatcaatccacctganctccaagcttttaaattttcaaaatttgaagcggcaacaggcaaccaatcagagccattctatcaagcatggtatggacttcacctctgttttccaggtagagaagcttcatgtgaagatcatctgccaacaaaggcgaggtgacggcatcttccaccgccataggattccgcatcatctccctctctagaatatctatacacagcctatcnnnanntgattcntgacnntgctnnatcttt

SEQ ID NO: 1075 - DNA, 456 bp, Zea mays
  misc_feature (15)..(16): n is a, c, g, or t
  misc_feature (25)..(26): n is a, c, g, or t
  misc_feature (32)..(32): n is a, c, g, or t
  misc_feature (46)..(53): n is a, c, g, or t
  misc_feature (56)..(56): n is a, c, g, or t
  misc_feature (84)..(87): n is a, c, g, or t
  misc_feature (135)..(135): n is a, c, g, or t
  misc_feature (198)..(198): n is a, c, g, or t
  misc_feature (310)..(310): n is a, c, g, or t
  misc_feature (366)..(366): n is a, c, g, or t
  misc_feature (399)..(400): n is a, c, g, or t
  misc_feature (414)..(414): n is a, c, g, or t
  unsure (1)..(456): unsure at all n locations
caaaaatagcttacnntaatctacnncaaagnagtcctgagatctnnnnnnnnctntggagattgatacagctttggaagctgnnnntgcctgataaaaaggttgatttggacccttagatagcttatccacgtntgctgtctccatccatgacttggattcacagcacaccgggtccatgccacatatcacgcctcnatatccttcagcaagagtgcatgatggtgcaaaaatcaaacaggataaacaagagcattcaccaagtcaatatcgaaaccaaatactaaactatggatttaatctcaaaagnaaatgaggatgaataaagccacagataagcgtagagaatgggacctttttcattcncttaatgaaatatttcccttttttctaaaaaanntacagataagcttnatcaacagattgaaaaagaacaaacacattatgcatcataat

SEQ ID NO: 1076 - DNA, 615 bp, Zea mays
ggtctcctccgtgatctttgatctcgacggcactctccttgacacaggtacgtacgcacgtgtatccatccacccagcctcctcgccatcccgctcccgctcccgctccgtgtggagtacgaccgatcagatagctgtgtcgtgtcgctgtgccgtaataactgatttgcatgcactgctcgcgcaaatgcgtgcgttgtcttggcgcacagagagggcgacaagggacgtcctcaccgaattcctggcggcatacgggaaggtccccgatgcgggggaggaggagaagaggctggggcagatgtatttggaatccactaccgggatcatcagagactacggcctgccgctcacggtcgacgagtactccaaggcgatgtatcccctgtacctgaaaaggttcctttttcacttcttacatgtacataacgcttgccagtctaatcgcttagtagtaataggctggctcgctttctcctactgtcctactacaggtggcaaaaggcaaaaccgcttccgggagtgaagaggcttgttaagcatcttcacaagaacggagtgccactcgcacttgcttctaactccattaggagaaatgttgatcacaaacttccg

SEQ ID NO: 1077 - DNA, 198 bp, Zea mays
acccacaattcacagtcaggcgataaatcctagtctgcggaccataaatcttcttcataaaggtcgtaactctgcctgtcagtcattccaccaaaataagaaaaaaaaatgttcaaacttgcatacaggaaacaaggagtaatgaaaacctgatcatggaacatcgcagacgcggtagcagcaccattagcacgaacc

SEQ ID NO: 1078 - DNA, 347 bp, Zea mays
ggaggaaatcgaaaggcttaagtgtgacaatgcagctctgacctcagagcttgaaaagaatgcacagaagaaacttgttacagagaaacgaatgcaggagctagaagataagttgatctttttggaggatcggcagaaaaatctgatggcgtatgtcagggatattgtacaggcaccaggatctttctctagctttgtgcagcaacctgatcatcacggaaagaaaaggagactaccagtacctatctctctctaccaagattctaatgctgaggggaaccaggttgtgcatgggagcttcatcaccaacccaccagcttgcagggaatcattcgacaagacggaat

SEQ ID NO: 1079 - DNA, 654 bp, Zea mays
  misc_feature (492)..(492): n is a, c, g, or t
  misc_feature (494)..(496): n is a, c, g, or t
  misc_feature (517)..(517): n is a, c, g, or t
  misc_feature (530)..(530): n is a, c, g, or t
  misc_feature (543)..(544): n is a, c, g, or t
  misc_feature (552)..(553): n is a, c, g, or t
  misc_feature (566)..(566): n is a, c, g, or t
  misc_feature (569)..(572): n is a, c, g, or t
  misc_feature (574)..(579): n is a, c, g, or t
  misc_feature (588)..(588): n is a, c, g, or t
  misc_feature (590)..(590): n is a, c, g, or t
  misc_feature (592)..(607): n is a, c, g, or t
  misc_feature (610)..(615): n is a, c, g, or t
  misc_feature (617)..(619): n is a, c, g, or t
  misc_feature (628)..(629): n is a, c, g, or t
  misc_feature (631)..(643): n is a, c, g, or t
  misc_feature (646)..(646): n is a, c, g, or t
  misc_feature (649)..(650): n is a, c, g, or t
  misc_feature (652)..(652): n is a, c, g, or t
  unsure (1)..(654): unsure at all n locations
aggtattttttgggggctttgttaatctcaatcaatcaatagaggacacaggcaaaaagcaagtataagttgtggtactttgctttcaaggagagattctgtcagcttgagtttctcagccatcttctccaattcatctgtaagctgccatcaaaatacaatctcataagaaataaaagggagtcatttgcatccaggtttctttttttactaaaaaagtacatatagccagtaattcagaagcatatttctttcaaagtgaagaaatttagaacccatatgagctggaacacttcatccgtcatttcattttttttaatgtgccattcctcccatgacccaagtgcggaggcacaaaagaagtatatttcaaaatcaagtaaatttaactatgtcttaaaccctaacagtcactttaagttcttgacaaccaaataatactcaaaaacatcactccattaaacaaaattcaattatagattcagtctctcncnnnaaagcaaccttgtgcgaccgngcaaaaaaaccgnaacccgaacaacnngaaaaacnngaacgacaattanggnnnngnnnnnngatacccgnantnnnnnnnnnnnnnnnnatnnnnnntnnntctctcgcnncnnnnnnnnnnnnnttnacnnanat

SEQ ID NO: 1080 - DNA, 727 bp, Zea mays
  misc_feature (5)..(9): n is a, c, g, or t
  misc_feature (548)..(550): n is a, c, g, or t
  misc_feature (554)..(554): n is a, c, g, or t
  misc_feature (594)..(594): n is a, c, g, or t
  misc_feature (602)..(602): n is a, c, g, or t
  misc_feature (612)..(615): n is a, c, g, or t
  misc_feature (620)..(621): n is a, c, g, or t
  misc_feature (638)..(648): n is a, c, g, or t
  misc_feature (655)..(662): n is a, c, g, or t
  misc_feature (667)..(683): n is a, c, g, or t
  misc_feature (685)..(689): n is a, c, g, or t
  misc_feature (694)..(695): n is a, c, g, or t
  misc_feature (703)..(707): n is a, c, g, or t
  misc_feature (710)..(713): n is a, c, g, or t
  misc_feature (716)..(716): n is a, c, g, or t
  misc_feature (718)..(724): n is a, c, g, or t
  misc_feature (726)..(726): n is a, c, g, or t
  unsure (1)..(727): unsure at all n locations
tgacnnnnnatcatgtggcctgtttacccttttgggaccttattatatgatatttggcttgaagcaaaatatggcacaccaaaccttagaaaaattaacattgccaaaagtttgttaccaataaacccatgggctgtccaaacattagcaagaaaatagactatggtttcacttggcaagggaaccttgtcgaatttctgtgggaaaacagatgcttgccaaatctggttaacacagccagattctgctaatgaaacattggctcagaatcttgtagaccctgatgtcatggccccatggtactgtggtctagtgcttgtatctttttagttggtacaactcatatccgtttgtttctaagatatttttaagattctactatgatttctttagcctcaaaccaccatgggtcctcttctgagctcatacaccatttttccaactaacatgacaccaagcaaacacttgggcatatacattctgctgcatggctgcatcatcatatttccacaatattcttagatccccaaatatatttcttggagctnnntttnccttcatttatgactcttcacagtattaccaatataaagnttaaaatncacatgcttnnnngctgnntttgcaatttacatatnnnnnnnnnnncttttannnnnnnnttaannnnnnnnnnnnnnnnntnnnnntgttnnacatgctnnnnntgnnnnganannnnnnntna

SEQ ID NO: 1081 - DNA, 722 bp, Zea mays
  misc_feature (531)..(531): n is a, c, g, or t
  misc_feature (583)..(589): n is a, c, g, or t
  misc_feature (639)..(642): n is a, c, g, or t
  misc_feature (653)..(654): n is a, c, g, or t
  misc_feature (671)..(678): n is a, c, g, or t
  misc_feature (685)..(687): n is a, c, g, or t
  misc_feature (694)..(708): n is a, c, g, or t
  misc_feature (710)..(710): n is a, c, g, or t
  misc_feature (720)..(721): n is a, c, g, or t
  unsure (1)..(722): unsure at all n locations
gttcctcaggttatagtcatacctggagcagagaaaagtctgtggctaattgagatagcactccagcaacaaaggcatcgccagcaccagttgtgtcaacagcacttaccttaagtccaccaactctaccactaaaatcctgttattccacaaaaatgtactgtaaacaacattttacagacctatgtgcataaggcattgttagcaagtaaatgtagttaagatttaagaaaagtttgttcactagaaataaatagttaattccattaatataatatccaacgccatgtaaatttttattggacaaaaatcatgtttatggtcatggagaaaaaaaagtaaattccgtaaccaagcaagaaataaaaatagtaccctctacatcataactgtaggattaccttagagtaatacctacagccgtctggaccttcagtgacaagaagcaacttcaggtttgagtgcataagtttctttacaacggcatcatcataaggatcctctccatttgtgagaaaggaaacctcctcntcacttacctttttgaaaagagaagcaaaatgcacaaattaacacaagattnnnnnnnacagctgaaccataatttacagaatagcaaccttgaaaatatcagcagtnnnncatacgctcannataccatctctagcatnnnnnnnngatgacnnnaatgaannnnnnnnnnnnnnntnatatgaaacnng

SEQ ID NO: 1082 - DNA, 711 bp, Zea mays
  misc_feature (240)..(240): n is a, c, g, or t
  misc_feature (304)..(304): n is a, c, g, or t
  misc_feature (398)..(398): n is a, c, g, or t
  misc_feature (535)..(535): n is a, c, g, or t
  misc_feature (649)..(650): n is a, c, g, or t
  misc_feature (660)..(662): n is a, c, g, or t
  misc_feature (672)..(680): n is a, c, g, or t
  misc_feature (682)..(684): n is a, c, g, or t
  misc_feature (686)..(687): n is a, c, g, or t
  misc_feature (689)..(690): n is a, c, g, or t
  misc_feature (693)..(700): n is a, c, g, or t
  misc_feature (705)..(706): n is a, c, g, or t
  misc_feature (709)..(709): n is a, c, g, or t
  unsure (1)..(711): unsure at all n locations
gtctaaagtgaggggtgttaacttgggaggatggttggtcattgaagggtggattaagccatcactttttgacgggattccaaatggggatatgctcgtaggtggattgatcttagttattcactgtgtgttcttggtaaactgatgcctgcatggttttaatcctctatggggttgtgtttgcaggatgggacacaggtgcagatccgctcagtggtattaaacaagtatgttagtgcngccaatggtggtggctcaaatgtgacagtggaccgtgatgtggcctcaacgtgggagacattcngggtgagagtacatggaatgtattagtttgatttcaaagaaatattagtctgctgctttctgttttacaaggggctaattctctgcgttattanggcaaatgatagtatctcaaacgtattggtctgatttcaaagaagtatgaaatgtattggccttactgtttgttttagttaaactttacattagggtaaacctacaagaactgcttaagtacaggctaaattctagntatacctctcttgctatgaccttaagtatgttgtaatagactaccccttaattgcactccaagttatgccactgggtaaaatttctcagattttgctatattggttttctgacnnagtttgaccnnntatcatgaannnnnnnnntnnngnncnnatnnnnnnnnatcannaantc

SEQ ID NO: 1083 - DNA, 741 bp, Zea mays
  misc_feature (104)..(166): n is a, c, g, or t
  unsure (1)..(741): unsure at all n locations
gttggcgagtaatcctctaccttggcccgggtcatgtttgtttgttctggtcggggtttgtgagtttgtttttttttgtaatctgttttggggttctctacccnnnnnnnnnnnnnnnnnnnnnnnnnnnnnnnnnnnnnnnnnnnnnnnnnnnnnnnnnnnnnnnttgcagatatatctcaaattaggtaaacataaattttggatagtggaatttacttaacttatagatgactatgttaaaatagaatgtgcttatatatcagtctacaggtctacagtcatatcagatcatgggtccatgcggttgttctataatagaggaagaccacaatcgactctgattaaatatatgatagaattaggcttgatctgtcctagagatagcagagttagaataggagtcggttaaggcagttgtaactgacttggactccctgtcatgttataattctgatggcaatattttgccctatatatactcagccccctggcccccctcgccctaataggttaggatgaacagtttaaacctggcatcatgttttcttacattataatcagaggcaactccactcaaatctagaaccctagccgacgacaataataaatctccatggcatctacctcaagttctgctatgccaacgccccttctagggcaatccgtggcggtaaagcttaccaagaacaacttcacattctggaaggcacaagttccacctaaccttaggggcgcgca

SEQ ID NO: 1084 - DNA, 1010 bp, Zea mays
  misc_feature (113)..(131): n is a, c, g, or t
  unsure (1)..(1010): unsure at all n locations
aggtttgcctgatgaaaagcctcctttgcttgtcaaaacacatggaggaccaactgctgaaacacgtgcaattctggacctcagtgtccagtattggacaagtagagggtggnnnnnnnnnnnnnnnnnnnatggaggaagcactggttatggaagagagtatcgggagagactattgaacaaatggggtattgttgatgttgatgattgctgcggctgtgcgagattcctggtggagagtgggaaagtagatgggcagcgcctttgtattactggtagatcagcaggtggatacactactttagcttcacttgcattcagagacacgttcaaggctggagcttctctctatggtgttggggacttgactctgttgagagcggagacgcacaaatttgagtctcattatatggacaatcttgtaggaaatgaaagagcttactacgagagatcaccaatcaactttgtcaaccagtttacttgtccagtcattttgtttcaagggttggaggataaggttgtgccaccagatcaggcacgcaaaatatacagtgccttgaaagagaaaggtttgcctgttgctttggttgaatatgaaggagagcagcatgggttccgtaaggcggagaacatcaagttcaccttggagcagcagatggtgttctttgcaagattagttgggaagtttgaggtggcagatgatataactccaatcaagattgagaacttcgattgatctcttggagagtggtgtccggttcgaagttttgttcacgtaacccgattatatgttcagtacattagccgttgcagtaccttttaggaatacgacttcatcttatttttgagggttgatggaaatctcttttttgcgctgtaacgatgaagtcaccttgttttctgttcggttctagaatgaaatagaacggaatgacactatcctttatttggttgatgagtgaaaatagataatttcataactatagtacattcatacaaccatatatata

SEQ ID NO: 1085 - DNA, 587 bp, Zea mays
  misc_feature (11)..(12): n is a, c, g, or t
  misc_feature (112)..(112): n is a, c, g, or t
  misc_feature (536)..(538): n is a, c, g, or t
  misc_feature (552)..(553): n is a, c, g, or t
  misc_feature (570)..(585): n is a, c, g, or t
  unsure (1)..(587): unsure at all n locations
catgcctgcanngtttttttgaggaacttcatgggccacgccgacgacttcggctcctctcgcttatgatatttcaacacatcaagcccacgtaaagcccttttctcggctnttgcccctccttgctcgctggctgtcttccccctgctgcggctcctcagtcctctcgcttctgttcccctatcgtcggcctccacaagcgccacgtctcgcgccctcgtccgctccccgccgatgagctgccgcgcggcgccgtggagtcgcccgtcgcacattgctggtccgcgtgtgcccaccccggcgcggccgcgcttcgcacttggtgaggtccacgagctccctctcgcctccagatttcgtggttatctgacttagctgttcgcttactgcctaccttgtgggttgtttccccgatgttgggcttgggctttacgtccgatggttagcatgtgctggtcaatgcgcgtaccgggtcacgatttagcttagctaggacaatagtttgaatattgactcatgttttacttatcttgccnnngataaatattttcnnttttttttttgctctgnnnnnnnnnnnnnnnnta

SEQ ID NO: 1086 - DNA, 752 bp, Zea mays
  misc_feature (65)..(65): n is a, c, g, or t
  misc_feature (72)..(72): n is a, c, g, or t
  misc_feature (267)..(267): n is a, c, g, or t
  misc_feature (274)..(274): n is a, c, g, or t
  misc_feature (323)..(323): n is a, c, g, or t
  misc_feature (341)..(341): n is a, c, g, or t
  unsure (1)..(752): unsure at all n locations
cacgttattcaagcaccaaaaatgtttggatagacccagctacatattgaacccatgcatatatnattttancctgtcaacacataaaagcaaaagaagtgaaaaagggataaggacatgttggatcaatgataggaacttatggctgaagatcaacaggagtaataacattacaacacattctctatgctttgtaaagtatttgaaaattagtcaaaccttgaagtgcaatgatttaatcctaattaccacaatcaaaacatcttngtcatcntgtaatcagtaacttaactaagacgaccatgactaaaagccaaacagangagattgctaaaatgacntcaatacagagcaaacagtaaaaactgcacaaatatatcaaccttaagactagggatattaacacccagtgattaatctaaagggagttgccaaacttaacacaactcagctaagtaccatgccgaaccaatctgcttgccgcaaaaataaaataagtggccaaacctaaatcttcctgcctcgcgatttctgcaggcacaaactagtaagcaatctctgaaattaaacccaggcataggtatatccgcagaggcaggtcaggatacaagtagaagctatagagctacatccgcgcgcctccacaagtccaaacgagtaacggcaaggcggcactcacagcgcgacgaggtcggggtggcagacgaggcagcgccacccgagcgaggagtacagctcaaagaacggccgca

SEQ ID NO: 1087 - DNA, 774 bp, Zea mays
  misc_feature (576)..(576): n is a, c, g, or t
  misc_feature (648)..(648): n is a, c, g, or t
  misc_feature (653)..(653): n is a, c, g, or t
  misc_feature (655)..(660): n is a, c, g, or t
  misc_feature (673)..(674): n is a, c, g, or t
  misc_feature (682)..(683): n is a, c, g, or t
  misc_feature (694)..(705): n is a, c, g, or t
  misc_feature (711)..(715): n is a, c, g, or t
  misc_feature (721)..(723): n is a, c, g, or t
  misc_feature (725)..(726): n is a, c, g, or t
  misc_feature (729)..(773): n is a, c, g, or t
  unsure (1)..(774): unsure at all n locations
atctagtgaagaggaagcggttaccttctcacagctggtgggatcatcatcgtatttcctttgtttttgtttcttctgaagttctgatccattcctctgccttgccaatataaatgattcaagatataatacacatgcatttcattcacactaggctaatttctcgctatctgttcctgttctttatcattatagttggctgtagatatatgatacatctgtatttcatttacacttggcatcatatattgtttcgtctgcatttctattgtgttcacgtggtctataaatcggtttcttaattttcttgctcatttgcagaacctcatcgatctggcaggttcagagagttcaagggctgaaactacaggagtacgccggaaggaaggatcttatatcaataaaagcttgctaactcttggaacggtgggcctcattcgctaatcactctcagattatacatccctgtaatatcaccattaatgcactatggtagatgctgtgttcatgcaatcatgcttttgagattatgtgttgctgcctatgcattatttgtgcatacaagagcttaattgntttcatttttatatttcatatttgaaccataaatgtgatcaatagaaatcttgaattggatagatatatgtnactancnnnnnntcctgaaacacanntcacaccnntatatgcagcnnnnnnnnnnnnactgannnnntacatnnntnngcnnnnnnnnnnnnnnnnnnnnnnnnnnnnnnnnnnnnnnnnnnnnnt

SEQ ID NO: 1088 - DNA, 707 bp, Zea mays
  misc_feature (133)..(133): n is a, c, g, or t
  misc_feature (159)..(159): n is a, c, g, or t
  misc_feature (221)..(228): n is a, c, g, or t
  misc_feature (463)..(463): n is a, c, g, or t
  misc_feature (568)..(571): n is a, c, g, or t
  misc_feature (598)..(599): n is a, c, g, or t
  misc_feature (621)..(621): n is a, c, g, or t
  misc_feature (623)..(626): n is a, c, g, or t
  misc_feature (628)..(631): n is a, c, g, or t
  misc_feature (633)..(633): n is a, c, g, or t
  misc_feature (635)..(637): n is a, c, g, or t
  misc_feature (640)..(644): n is a, c, g, or t
  misc_feature (648)..(651): n is a, c, g, or t
  misc_feature (656)..(660): n is a, c, g, or t
  misc_feature (662)..(667): n is a, c, g, or t
  misc_feature (670)..(706): n is a, c, g, or t
  unsure (1)..(707): unsure at all n locations
gccaggccgcttgtcccgccgggttttgcaaatgcattcgctgacaagaagcttcagtcacagtcgtctaacatcacacatgagccgaaggtgtgtatctagatgccgtttcaatagataatagaatgacagnaattacacacaaaatctcctaccttncaatccttgataccttttcagaaattgttgtgttcattgaagatagaaccttcagttcttcnnnnnnnntctccaatagaatcatttccttacgaaaagagggataaccccaccaatgctgtagtgatacttaatttgtttctactttgtagtgtcataatgctactactgaagctaacatgttgactattgcatggcttgggggtcagctagaggatgaccagtcagcaacagggttcacatctgaaagtaaagagaagggagtttctggtaacgatgctactatgggtccaaagcacacgcntccacctggtagtgttacctcttcagctgaattggcttctagcgttctgaaagggagcgaggattgggaagctgatgtaatggataagtattctattggaaaagnnnncaaatctaaaaatattgatccagttannaaggatgattcagtagcaatcntnnnncnnnncntnnncannnnnttannnnaaagnnnnngnnnnnnacnnnnnnnnnnnnnnnnnnnnnnnnnnnnnnnnnnnnnt

SEQ ID NO: 1089 - DNA, 762 bp, Zea mays
  misc_feature (1)..(7): n is a, c, g, or t
  misc_feature (108)..(108): n is a, c, g, or t
  misc_feature (142)..(142): n is a, c, g, or t
  misc_feature (182)..(182): n is a, c, g, or t
  misc_feature (185)..(185): n is a, c, g, or t
  misc_feature (271)..(271): n is a, c, g, or t
  misc_feature (322)..(324): n is a, c, g, or t
  misc_feature (335)..(335): n is a, c, g, or t
  misc_feature (506)..(506): n is a, c, g, or t
  misc_feature (585)..(585): n is a, c, g, or t
  misc_feature (613)..(615): n is a, c, g, or t
  misc_feature (644)..(648): n is a, c, g, or t
  misc_feature (666)..(666): n is a, c, g, or t
  misc_feature (671)..(674): n is a, c, g, or t
  misc_feature (677)..(678): n is a, c, g, or t
  misc_feature (680)..(683): n is a, c, g, or t
  misc_feature (695)..(697): n is a, c, g, or t
  misc_feature (702)..(708): n is a, c, g, or t
  misc_feature (710)..(714): n is a, c, g, or t
  misc_feature (716)..(742): n is a, c, g, or t
  misc_feature (749)..(753): n is a, c, g, or t
  misc_feature (755)..(760): n is a, c, g, or t
  unsure (1)..(762): unsure at all n locations
nnnnnnnacgttccggtactactcccaccactggaggacctgggccgcgtgcttcatccagcacgcctggcgccgcctgaggaggaggaagatggccaaggacctgantctgagggagtcgttctcgtccacgggaccgtangaaggcgatggcgacgacgcctcctcccctgaacagagtntcncacttaggagaggagccggcagcatcatcagggagctgcctaagttcaggaagccatcggagccggatttctcggcggagcatgangactgactgactggcggaggactgaatggctgatacattgtttgttaaggnnncaaaagattgntgcttctgatcggttgttcatactgtacatacatatgtagtggtgcttgtcattgtattgtagggatcccaccgtagattagaaagattgcttgtgtccgctggccgagcagattttgcttcccgggtcagggctctaccattcttttttcttcttttcttccaagtgtgnaaattgcagcaggatgtactgttgtctgtttctcttacaccggtctggttgttgattctgtgaaattttgttgtgtgantaccgagactctgatcattttacagttnnncctgctctcctctgtgtggcacaaatgcnnnnngacttgcaacagacgttnctttnnnncgnngnnnngtttttttaacnnngagcnnnnnnngnnnnntnnnnnnnnnnnnnnnnnnnnnnnnnnntcacccnnnnncnnnnnnct

SEQ ID NO: 1090 - DNA, 704 bp, Zea mays
tgcatgcctgcaggtactgcatggccgtgcccatgtcctcctccatcatcttcgccacctggtgctccgccacccgcagcccgccgccgttgccgctcttggtggtagcgctagtgttgccgccgccgcgcttccattgctctttccctgcacgtgcgcgtgatcaatgcatggatgacgacgatgctcttgccatgacatttgttatgttggtggtggcgagtggccgagcgagtgccaaatgctctggttggttaccgccgtacatacgtacctctgatgaagccatgctcgcaaccagaggcgccatcccgccggcggctccgcccagccggctcatgctgagaacctgtgcgcaagcgcaatgcaatgcacaactaacgtcagcacgtactgcactggcactcgatcgcactgaatcaaagacatgaactgccaactaaatagcatcaccttgacttggagctgcaagaacctgacgtagtcgatgatctcgtccagcatcgacgccttgtccgtctgcaaaaccacaaacaacgacgatcgaccgccccacacaacgtcgccatttcagtgttgattgttgacgacgcgagcgagagagaagaggaaggagctagctagctagctagagggggatgccgaccttgttggcgttcgggaccatgtccttgtagcgactttattcggttcgggaaccttta

SEQ ID NO: 1091 - DNA, 750 bp, Zea mays
  misc_feature (5)..(17): n is a, c, g, or t
  misc_feature (39)..(43): n is a, c, g, or t
  misc_feature (440)..(441): n is a, c, g, or t
  misc_feature (588)..(588): n is a, c, g, or t
  misc_feature (592)..(592): n is a, c, g, or t
  misc_feature (598)..(598): n is a, c, g, or t
  misc_feature (620)..(620): n is a, c, g, or t
  misc_feature (680)..(683): n is a, c, g, or t
  misc_feature (688)..(691): n is a, c, g, or t
  misc_feature (693)..(697): n is a, c, g, or t
  misc_feature (699)..(699): n is a, c, g, or t
  misc_feature (701)..(706): n is a, c, g, or t
  misc_feature (709)..(716): n is a, c, g, or t
  misc_feature (719)..(726): n is a, c, g, or t
  misc_feature (730)..(744): n is a, c, g, or t
  unsure (1)..(750): unsure at all n locations
gtctnnnnnnnnnnnnnagcgcataagcaccactctctnnnnnactccacacatctgcagagcatacgtacacagtctggttataatgttaactcgaggaaaacaaatgatgcgttcgcccatgacccatgaaaacgtgtgccattgcgcttacacaccttattgtagagatggggaacttgtaactgaccagctgtgccctcagaaaccaattcattggtagctggaaacgaggatcccagttatcaaaacaaacaaatgaacaaacctcaagactcaagagtatatgtcaacaacaacacatctttagagagagtttagtaagacaagagtcatgcatgacacacgattaaaaattgtgagcatctgccccagcatgttctatgccactatgtgactgtctcttcctgcataggtggagagaaggaatatatatatanngggaataagagatcacttacaaattggctcaagattgggcaattcccgcaacagttcactgatatctggaataaaaggagcatgtcctgctggaacaccttgttcagtaatatcatcaggaacaggaatttttttctttatctgcangagnaaaagntacgctttaaaaaatgctgcangatactacatgaacagctactgtgcactcccatgtgagctttgagtgcatgcctgttcannnnaaaannnntnnnnncntnnnnnngcnnnnnnnntannnnnnnntctnnnnnnnnnnnnnnntctctt

SEQ ID NO: 1092 - DNA, 766 bp, Zea mays
cttgcatgcctgcagtggttatgaaattccacaggccaatttattttaattaatttctgcccagcaaacttgagaacataatctggaaatggtaattgaccacatggcatttgttcgtaaccacataaaaacgtaatgcaagcacctgatctgaggaatcacatatgcaataaagcaaagcaaaaacacaactgacctgaggaaccacatatgcaacaagaaacaaagggatagtcaggacattgaggtatattctatagtactgcaaacaagaaacaagtattttcagaaaaaagacagatttttacataaaagtaatgaaaatagaacacatacaaagtaaacagtttttttaacacgcaggagaactgcgtatcatttcattaagaaaggagaaagtacacaaggaaaggaatctgtatacaccaagacaaactaaaaatgttctaacgcaccgaccagccaccctgagaacaggaggtgacaacgcaacaacactagcctctgttcgagacccttacaaccagctgctggggccccttggccccagccgaacaccagagcactccatcgctagcaatgtcctgtaaagccaccaccaaatctggcatcatcccatcgaagacacatctgttatggtgtttccaaagttcccaagccaccagaatggtgagagagttcatccccttcttcaactcctttggaaccaacttttcaccaaatattttcatccgcatacagagaatcccgtgttgaagaacccttg

SEQ ID NO: 1093 - DNA, 694 bp, Zea mays
  misc_feature (530)..(532): n is a, c, g, or t
  misc_feature (571)..(572): n is a, c, g, or t
  misc_feature (596)..(596): n is a, c, g, or t
  misc_feature (601)..(602): n is a, c, g, or t
  misc_feature (606)..(606): n is a, c, g, or t
  misc_feature (613)..(615): n is a, c, g, or t
  misc_feature (617)..(623): n is a, c, g, or t
  misc_feature (626)..(626): n is a, c, g, or t
  misc_feature (628)..(628): n is a, c, g, or t
  misc_feature (630)..(630): n is a, c, g, or t
  misc_feature (632)..(632): n is a, c, g, or t
  misc_feature (637)..(638): n is a, c, g, or t
  misc_feature (640)..(643): n is a, c, g, or t
  misc_feature (646)..(678): n is a, c, g, or t
  misc_feature (680)..(680): n is a, c, g, or t
  misc_feature (684)..(684): n is a, c, g, or t
  misc_feature (686)..(689): n is a, c, g, or t
  misc_feature (692)..(693): n is a, c, g, or t
  unsure (1)..(694): unsure at all n locations
acacctcggccagctccagcttctcggcagtcaggctggtggagtccatggtcttgctgaggaccttaagcgcgagggcgacggcctcctcgcgggtcaagccgtccttgtagtcctgcttgagcatggactgcgcggcctggctgttggccccaacagcggcggccttccacccgccgtagttcccggatgggtcgctcatgtagagctggaagccgtggtgcttgtcccacccggcgaataggaaggagaccccgaaggggcggaggcctccgaactgggtgtacccctgcttggtgtcgcagagggactggacgagctgctcgacggggatgggttcctggtaggagagcgcgtagcgttgggcgtggaggcgggcggtgttgatgaggatgttggcgtcggacatgatcccggccacggcgcacgccaggtgggagtcgatcttgtacatcttctcggcggagcgcgaggtctggaggagcttggaggtcaccttcttctcgccgacgaggaccacgccgtcggcnnntaggatcccgagggctgacccggcgttgccgatcgcctnnatcgcgtactccacctggtagagncgccnntccngcgagannntnnnnnnncgncngncntagcnncnnnncannnnnnnnnnnnnnnnnnnnnnnnnnnnnnnnngnttgngnnnnctnna

SEQ ID NO: 1094 - DNA, 1206 bp, Zea mays
  misc_feature (506)..(506): n is a, c, g, or t
  misc_feature (684)..(684): n is a, c, g, or t
  misc_feature (1058)..(1058): n is a, c, g, or t
  misc_feature (1140)..(1140): n is a, c, g, or t
  misc_feature (1163)..(1163): n is a, c, g, or t
  unsure (1)..(1206): unsure at all n locations
gcgctgaagagcagcctctacggcatccacagcatcatattctgttacctgaagaagatcaggaattgaccaagccgttagacactaataaattatagaagcaatactcctaaatgaaatacataaagagaagggcaatgaggggaagacgctagagttataaactacacacaggcagaaactctgcaatcaatcataaatgcaccctacgagtaaacaaatggtcacataacttctcccaatgacaatcattatagataacataggtaatcgcaattcgtaaggtgaatcactaaggaggcttccaactttgtatatacactgatttggagcagtttgaacatagcctacatattatttgcatgaagaaagtaacaagactacataataatacaagatggaatcatcagtgcagtcttctgagtagaaagtgtataacagtagagatggctgataagaatttttaactcaccgtaattggttcctccatgtccaacatactaagnattgttgaccagcatttctccatattcaccgatgcaccaaacagccaccctaactaaactttcctaaatatatcaacatagaagagatctatgcacattagatacataatccaagagtatacatgacaaagaacatttattatttctccacacctgttcactagatgcttgcaatgcnttatataatgacctgactgaatatccttgaagttcagatgcattactcactagaactataagagcatgccatacatcatccttcacatgattaccagcctgtggacataaaaaggtacagtattaattggaatctttaatttacatctgcaacagaaattcatgctcatacatttacagctcaattatttacttagcggaagggaaatcatatagaaacaaaggtgtgtgcaacactaaatgtggtagattatttggcaattggcattttggtttagtaagttggtcttgaatcttttcactggtggagttaccacatctggaaggaaaaggtgtgcgtgacaaggattcgataatagacattgctggcactgngtagatcatagatcagaactcccgaacatagtattccagtgaatgcttaatagtagtccgtaaccctgatcaagtatgctantctttctctccttaagttaggtnaaaaaaacaagactactctactgaatatacgagcaactagtat

SEQ ID NO: 1095 - DNA, 557 bp, Zea mays
  misc_feature (1)..(8): n is a, c, g, or t
  misc_feature (21)..(21): n is a, c, g, or t
  misc_feature (47)..(47): n is a, c, g, or t
  misc_feature (94)..(94): n is a, c, g, or t
  misc_feature (110)..(110): n is a, c, g, or t
  misc_feature (196)..(198): n is a, c, g, or t
  misc_feature (223)..(225): n is a, c, g, or t
  misc_feature (227)..(228): n is a, c, g, or t
  misc_feature (283)..(283): n is a, c, g, or t
  misc_feature (326)..(326): n is a, c, g, or t
  misc_feature (392)..(394): n is a, c, g, or t
  misc_feature (440)..(440): n is a, c, g, or t
  unsure (1)..(557): unsure at all n locations
nnnnnnnnattccgaacaagngtaggcgctgtttgaaacgttaaagnttaaggaaagtttcagtttcggatagtttgctcctaaacaggtctanctctctatcagtctangtgatggtctccggttaatcttgcgtgctcctttacgccatgccgggccgaccaaatctgtttggctgaaagcagcagcggggtcnnncttgtcacctgctggcggacccctnnncnnctaggctctcgtcgtgtcacgtgctggcggtggcggcagccggcaaaggaggccngacggcgacggggcacacgctgcggtgccgcgcggggattggncgacctggccggcgctgtggacggacgacggacacggaggacttgccgtgccgtgcgaggcgtacnnnctgtctgtcccgccgaaaatgacaggcggtggtggtaatgtcactngtccgtcctcatcgtcagctggccaatgatgtgcgtgtcggcaaaaattgattacggcgctggagagccgccgccctggcctggcccctccctggaggatggacctggacctggctg

SEQ ID NO: 1096 - DNA, 1170 bp, Zea mays
  misc_feature (713)..(713): n is a, c, g, or t
  unsure (1)..(1170): unsure at all n locations
ggattatcaggtctaggttttggtggtggatttgaaaggctgcattatctgtaagaaacacgtttgatcttctaattcaaaattagagggaagaacacgatatatctgatttctgatctgcaccatttcttgctattttgtccagtgcaggcttgagagggtgtgggatcctgtacttgtcgctggagctaaaaagaggataagctattacttcttaaaagaggtgaaacctctattactttatgtacagcgttaacgtttttagatctccaatgcggataacctaacattatattctctagttcgaaatgtggctagattttgatcaaaatcctctttatgccctcttgcacgagtctatctactgtgaggtaacttgtgaaccttaggctagtacttactatgtttatggtcctactagcactcctgaagtcctattttgtttatggtcttggattcagggctcttcatcaaaatggtctgctgaaaagattcatggcgaatatgggagtttgtttgaccctattaaagctacagaagaaggccgagctgtgtactttactggagaggtactcgtttggacatcttgctggacccttgggtaaaatcaaattaaaaaaggagcttgtgtaatgtcaataaccttccatgtgtgtgtttattctttcatcttgagacaaaactataggcagaagctgtcaactatcctactncatttttttcaacatacgcttccctaaaattcgatataattaatgtattcatttttttttgttacgcagatggtgttcccttgcatgttcgatgacatccctgctctacgagacctaaaggaggctgcctgtttgttagctgagaaggaagactggcctccgctctatgatgtcagcgtgttgaacaacaataaggtgcgttgttcataagggtcgtaccataattcatactgtaagggctagtttgggaaccacattttcctaagggatttttatttttccaaggaaaattagttcattttcacatggaaaaatgtagttcccaaactagccctaaaagaagtttccatctatttattcacatactatacatgatcagagtccagggaaaaaaataattcggtatttccagctgactccggtctggatggcagtcatgtattagttcgctgatcgc

SEQ ID NO: 1097 - DNA, 1194 bp, Zea mays
  misc_feature (1189)..(1192): n is a, c, g, or t
  unsure (1)..(1194): unsure at all n locations
ggccagcggcgcgttgcagaccacggtggcgatgatgacggccagcgccgcgaccgtggcgaggccgaccgcgtcgtacaggatcgctagagcgatgcagagctggacgctcgtcgtccacgtctggtggaaccagtacgggaactcgccgatccggtaggcgtcgacggtgacgtagttcatgatctcgccggaagagtgcttcagcttcgccgagttggacagcctctgatgcttcttgtagacggcggccgacaggaacgaccgcacctggagccctagcctccgcgtgcggaagtaccactgcctctgcgacagagattcgcagcatttgcagaggaacatcgctacggccaacacgtagccttcgtacttgaaggaccctttcccgagcgagacgttgatgaatgctttcagaagcaccgggcccgaagacagcgtgagaaccttgagcagtgcaaagagacccgagaccaagatcccagttttctggcaagaaaccatggtccaaaacatcgacgggttgccgtgtgcccgcagctgcttcttcctgttgagcttctccaggaacaccaggtactggctgtacgctcggtccgagggacccaagagcggcatgtctttctcctcgagcggcttctcgtagcccgtcttcatcatcgggttcatccaccagaacgacatcacgctgaaaaccccggctttagcgaacggggtcacatggctctcagacccacccctctcatcatcaacagtgtcgtcagtcttcaagggcttatacaaagaagcagcagttccagttccgccatcaccgtcctcttccttgacgcaccaagcgccacagacaagcagcagtgcacctggcaggaacagagcgtccagaaaacccttcatggtcagtgccctatccgcaaccatgtgaacgaccgaggaacaagcgacgaacgcggcgtacgcggccagcagagccgaccacgcgcgcgcagacattggcccgaggagacgtgctcctccgacgccgctgagagcgaagccggcgaggaccaagcagagtccctgggacagtgccgtcacccaccagtgtgggaggtaagcggaagcgtgctgagtgaagttgctccccagcatccacgacgcgaggccgaggtagacgaggcccaagcaggcggtgaacgccgcgccggccagnnnnag

SEQ ID NO: 1098 - DNA, 707 bp, Zea mays
  misc_feature (541)..(541): n is a, c, g, or t
  misc_feature (569)..(569): n is a, c, g, or t
  misc_feature (627)..(628): n is a, c, g, or t
  misc_feature (633)..(634): n is a, c, g, or t
  misc_feature (638)..(640): n is a, c, g, or t
  misc_feature (675)..(676): n is a, c, g, or t
  misc_feature (681)..(681): n is a, c, g, or t
  misc_feature (683)..(683): n is a, c, g, or t
  misc_feature (687)..(693): n is a, c, g, or t
  misc_feature (695)..(704): n is a, c, g, or t
  unsure (1)..(707): unsure at all n locations
catgcctgcaggggcttgggcatgcccaggagactgttctccaagaatgccgctcccatatttcccagcagctgttcttcctttagacctcttgcctctggatgctttgcccacatttgttatttggacgtcaggtagcttgcccttgccttcatctgatgatatgccagtttcttgtacaactgtccctagaggagcaagattaagtagttccgggtcatcttcaaagccaaatggacgctttgctgggtccatttttctgaatgtaatggatatcctgtgttttagaaagtagtgcgttagattttctttaatacgtagttcaatgaattttgaaaaacaatacgaaagatgagccgtgagcgtcaccttttggtagggactgctgggacacaatgttttgctacatcagcaccattgccattcaggactagcacagatctgtggattttcatatgtagtaagagagccgtacaattaatctgatggcctaacgatttagcaattactagttttgtgaacagtaccactggaaaacaangacacaattgtacaaatcataaaactanagatatatgcgactatagtcattaaaatggaaacaagatacaccaaattcaaatgttnnaaatnnatannncatgctgcaagcccgcgataaatcatagtacatanncattngnagcnnnnnnntnnnnnnnnnnaaa

SEQ ID NO: 1099 - DNA, 638 bp, Zea mays
  misc_feature (559)..(559): n is a, c, g, or t
  misc_feature (566)..(566): n is a, c, g, or t
  misc_feature (579)..(579): n is a, c, g, or t
  misc_feature (585)..(585): n is a, c, g, or t
  misc_feature (589)..(590): n is a, c, g, or t
  misc_feature (594)..(594): n is a, c, g, or t
  misc_feature (597)..(598): n is a, c, g, or t
  misc_feature (607)..(637): n is a, c, g, or t
  unsure (1)..(638): unsure at all n locations
ccttctgctggaaatggtcggtgctgagcctgctatcagaaacctccagcgagcttccgatcttctgtttctgccggcggtaccaggagaacgcaaataaaccgcaaaatgcagcaccgatcaccgccgcgacaacagcgacgataagaactccttgggacgcgtttgcggactttgagcaactagcgcctgagcagccgtctggatttgctgattgaggcacctgccttgtcttgacagtaccgtctggtccaaaaggctcgggcttgctgggcttcaggccatcctctgaagaaaggcaaagctctagcaaactgaagccagcgccacaaagccctttgttattcatatactggaagccaccattcagtctcctcaatcctagcatccaacacagaattgtagtggttaaaataccatgaagactaacaaaaaaaagtacaagtttcagaaaggctatgagattattaccaacagggacactcccagaaagggtgttgttgcgaacatcaaagacctcaagcaatggaacctcagcaatcttggatgggattgaacnaaacagnctgttgaagctcnaatcangccnnctcngcnntgttagctnnnnnnnnnnnnnnnnnnnnnnnnnnnnnnnc

SEQ ID NO: 1100 - DNA, 704 bp, Zea mays
  misc_feature (336)..(336): n is a, c, g, or t
  misc_feature (339)..(339): n is a, c, g, or t
  misc_feature (562)..(566): n is a, c, g, or t
  misc_feature (568)..(569): n is a, c, g, or t
  misc_feature (635)..(637): n is a, c, g, or t
  misc_feature (652)..(656): n is a, c, g, or t
  misc_feature (660)..(661): n is a, c, g, or t
  misc_feature (682)..(685): n is a, c, g, or t
  misc_feature (691)..(693): n is a, c, g, or t
  misc_feature (695)..(696): n is a, c, g, or t
  unsure (1)..(704): unsure at all n locations
caaaatagggcagtaatgatagcagtggatcacctgcaaaatacaagtaacaaaaattaacgacaaaaaagaattttccaaaccaaaacgtagctagattatcttgtcggaagtttatagctccagaaaatctggaacaaggacgagaggaaatgcacaaaggaataaagaacatattatctcaaaggtagcaagttcaaacttcaaaaaaggaaatttgtgagaacagaaggccacagcaaaattggggatatgggcaaacaagaaactacacgtgtatggatctaggcccacctatcaccagtgggtatggcatggtatagatcaatgggtgantgngaaaacatttatatcatgttaattattgagttatgactacaaaaaatagaagatcatagctatggattgactccggatcaagagttcaatgggactgcggcaaaaaaagacacaaaatatactagtccctgacatcagttgtatactcttagtgacaggaggcatgaacaaatgcatgtatagtgtactccccacaatagtaaaatagtgagcattatctagnnnnncnngttccaaatgtcaccaggtgtatatcactcgtcatattcacaacaaaactaactaaacagcaactnnntttatgcagatgcannnnnagcnnaagcgatccatgcatgcatcnnnnacatannntnngtgtacac

SEQ ID NO: 1101 - DNA, 536 bp, Zea mays
  misc_feature (49)..(49): n is a, c, g, or t
  misc_feature (242)..(243): n is a, c, g, or t
  unsure (1)..(536): unsure at all n locations
tgcagtactcaccaaatctgcgttgcactactgtaagaacaaatttganattgtaactgacgaattagtgaatccaaactcttctctaggtctgtaatattatgtgtactataatgtttatctactctacaaccatcattggcagcttaattgtgatcataccacagtatccaaacactccaacgttgtacaattcactctgatttactatgcaacacagttgtacaattcactctaatttnnactatgcaacacacgcgcatgtgcgcgcagtcgcagagcacactagtttcatatatactccctccaaccatagatgcaagaccattagatttgacctaaacagttaggcaatcccgagcagatagagaaatcatgtgtagccgtatatctacttgaactatctatctatgtatggatttgagcgccaaatctctcgtttggttgtaaccggtggactgaaaagtgggtggaaataatgtgtgaaatgacaaaattcgatgtggtctctagctggagtatttattagtttctgt

SEQ ID NO: 1102 - DNA, 1097 bp, Zea mays
  misc_feature (517)..(518): n is a, c, g, or t
  misc_feature (521)..(524): n is a, c, g, or t
  misc_feature (530)..(532): n is a, c, g, or t
  misc_feature (534)..(538): n is a, c, g, or t
  misc_feature (555)..(558): n is a, c, g, or t
  misc_feature (561)..(565): n is a, c, g, or t
  misc_feature (569)..(569): n is a, c, g, or t
  misc_feature (592)..(593): n is a, c, g, or t
  misc_feature (1091)..(1095): n is a, c, g, or t
  unsure (1)..(1097): unsure at all n locations
tataatatgaatggtctaaaaagataatatagaagtatttcagcataatattgaggattaagataagaacatattaggttcacaggaaaaaaaaatgagggtgcttttgaaactcaacttggtgatggacaataaaataagattatttatagtttttagaataattgtgccaactggttgcaaatggatgcctcaaatgtttacacttcaatttaatcatgccacaggaaaatttgtgaaagtttagttccacactgagaaaaacaatccaactttatttattgatacctttatttttaggtgcaaacatcaaataaccaaaattctaacatgtcagtatttacctgataaaaggaagctaatctaacatagccagtcttgcactcatggccatcgtctgttctatgagagataattgcagttgacagaggtgaaaggttgataatttcacgagacagctggacctttggaaacaaaaggtagtggacataattaggaaacactcgatcactgtctnngtnnnnaaatgnnncnnnnntggttaatgaatttttnnnngannnnntacngcaatttgatgagctctgtaggnncagatcatacatttcaaattacacatataaaaatcttaagattttacaattcttcgttcagcaagttaggcattacctccttttgtcttaaacccccacacctttcatcgtcagttccctggatataaatatgcatcggtaagaaagtaaatacaaagacgaggagcaacgtttccatggctgagttcaccaaattacataaaggggattcaggatatgatataatataatagaagcctagtatgccagacttcggtgaaccaaaaaaacgcgatgtttttttagttctataaaccaaaaccttggccacttattcaatctctgaatgttttttttaaacaagtgccttaatgttgaactggcacatctcaagttgaagtatacttcacaaccagcaaaatagatttaactgaagctaagtatctactatgaagctcaaggtaaggaaatacatctaaaaacttcactttcactgttgttcctacacggcctctaagnnnnnga

SEQ ID NO: 1103 - DNA, 640 bp, Zea mays
  misc_feature (418)..(418): n is a, c, g, or t
  misc_feature (423)..(423): n is a, c, g, or t
  misc_feature (479)..(480): n is a, c, g, or t
  misc_feature (482)..(484): n is a, c, g, or t
  misc_feature (574)..(574): n is a, c, g, or t
  unsure (1)..(640): unsure at all n locations
ggcgcatcatcttccagtcagctctgcacgtgccacactgccactgccaaatctccgtgatggtggtgggctgcatgtttgcgcaaactttctgccgaggccgaataccaacgagtcgagtagacgaaggaatcaccggcgagttcgatcggccccaatgcaaggttctctgtgtgtgcgtgggtgtgtggacggtggtggagaggtagatggcgaggcggaggagatggagatggggagatctatttatacatgatgatgacgcgtgcggaggctgcgatcaccagtcggtcgccaaacgagagcgtttcccacagcgtcgtttccaagcgacccttggcacctgttcagttgcttccttcagtcggaaggtccctctgcttccgacgtgaatcgcacgcagggtttagaggttcantctcngtacgcagcctaatctctcacaataaggagaagacgccaatttgatctctctcatnncnnntataccgtttgacaaacatggtaatgctcttgccacacccgtgacatatctttgcctttatcttttatgttcggtcggttacgagattcntcgctactcacattcacacgactgactacgactacacgagaggcggttggccttgatcagacagac

SEQ ID NO: 1104 - DNA, 1025 bp, Zea mays
  misc_feature (23)..(26): n is a, c, g, or t
  misc_feature (32)..(32): n is a, c, g, or t
  misc_feature (89)..(92): n is a, c, g, or t
  misc_feature (100)..(102): n is a, c, g, or t
  misc_feature (161)..(161): n is a, c, g, or t
  misc_feature (174)..(174): n is a, c, g, or t
  misc_feature (211)..(211): n is a, c, g, or t
  misc_feature (217)..(217): n is a, c, g, or t
  misc_feature (262)..(262): n is a, c, g, or t
  misc_feature (402)..(402): n is a, c, g, or t
  misc_feature (429)..(429): n is a, c, g, or t
  misc_feature (435)..(435): n is a, c, g, or t
  misc_feature (550)..(550): n is a, c, g, or t
  misc_feature (582)..(582): n is a, c, g, or t
  misc_feature (660)..(660): n is a, c, g, or t
  misc_feature (682)..(687): n is a, c, g, or t
  misc_feature (699)..(699): n is a, c, g, or t
  misc_feature (704)..(704): n is a, c, g, or t
  misc_feature (883)..(883): n is a, c, g, or t
  misc_feature (902)..(912): n is a, c, g, or t
  misc_feature (914)..(914): n is a, c, g, or t
  misc_feature (916)..(925): n is a, c, g, or t
  misc_feature (930)..(934): n is a, c, g, or t
  misc_feature (949)..(951): n is a, c, g, or t
  misc_feature (965)..(965): n is a, c, g, or t
  misc_feature (970)..(975): n is a, c, g, or t
  misc_feature (977)..(988): n is a, c, g, or t
  misc_feature (994)..(1002): n is a, c, g, or t
  misc_feature (1005)..(1020): n is a, c, g, or t
  unsure (1)..(1025): unsure at all n locations
tgtcttcctttatttgtgtctcnnnngactgntctctgtcctgtcatgaaatttgtactgatctcatgtccatctgcagcactgggagnnnnattttctnnncagacaccgtgtgcacgttgcaggtatgctgcattctgaatccttaacactttgtcccncttccatctgctnaacacacggagctgaaacgcaggtcataaaccaagangagacnccaaggctgtacagcctggtgtttggagaaggagttgtcaacgangcaacggcggtcgttcttttcaatgccatcaaggatctcgatatcagtcggctcaagggtggggttgtgctaaaagtgatatttgacttcctctatctctttgcaaccagcactgtcctcggaatctcagtaagaactgnttttttcttccatatatatgcattagngccatntctttgtacacccttaactctttaccgcaaatttgtcagatcggtctagtaactgcatatgttctcaaagctctgtattttggtaggtgagtaatcgttgttaccgatcggtttngtttgtgttcatctgctactcttttatctttnaaatctcttccccatattttgttcaggcattcgaccgatagagaggttgccttgatggctctcatggcctatctatcntatatgctggcagaggtaagannnnnnttaccaaatttnatctnctagtacttacattatgcacttccacaattcatcccaagatgctgcatgttctgcagttgctagagctgagtggaattttgaccgtgttcttttgcggcattgtcatgtcccattatgcatggcacaacgtgacagagagctcaaggattacaacaaagtgagctcaataatcaatgtncaaacatttcttaagaatnnnnnnnnnnntncnnnnnnnnnnttcgnnnnnattctcagcaatgtnnntgctgttgcgaagncatcnnnnnncnnnnnnnnnnnngcaggnnnnnnnnnaannnnnnnnnnnnnnnnagaca

SEQ ID NO: 1105 - DNA, 804 bp, Zea mays
tttgcatgcctgcagccgcctccttgagcacatgcgagttcacttccccgaccttggcgtcacccaatcggactgcgaggagataagctggatccagtccaccgtgtacttcgccttctactcgagctccaagccactggagctgctcctggacaggagcggcgagacgcccagatacgtcaaggccaagtccgactacgtgcaagaacccatcccacggcacgtgtgggagagaacatggtcatggctggagaagcccgaggccgggctgctcatcctggacccctacggcggccggatgggcagcatctctccgtcagcgacgccgttcccgcaccggaaggggaacctgtacaacctccagtactactcgtattggttcgagaatggcactgcggcattggagaagcggatgagctgggtcagggggctgtacgaggagatggagccgtatgtgtccaagaacccaagaactggatatgtcaactacagggacctggatcttgggacgaacgagttggaggacaatgtgactagctacgccagggcgaggatctggggggagaagtatttcaaaggcaattttgagaggctggcagctgtgaaggccatggcggatcctgatgacttcttcaggaatgagcagagcatccctcctcttcccgctgcaaaaggatggggcttcatttgagtggtcgtttgtttcgtagctttgtggtggtggatttcttggctacatttgtgaattgtgaacaccggtgaggaattgcatgggtgaagtgtaaaatcacttttggatttcgg

SEQ ID NO: 1106 - DNA, 1265 bp, Zea mays
  misc_feature (361)..(361): n is a, c, g, or t
  misc_feature (704)..(704): n is a, c, g, or t
  misc_feature (749)..(749): n is a, c, g, or t
  misc_feature (1256)..(1264): n is a, c, g, or t
  unsure (1)..(1265): unsure at all n locations
gtggatgaaataggttgctgctttgtcttttgtgcagcttttaaactaatgttttcatttgttgtgctgaaggcatcgttcacctgttaaagaaataaagagagaatatatttgcaaggtaaattgaaacctgtgtttgtcaatgttattgctgaaatcagttgacatcgttagttcttcactagcctccttgatgcattctgatcttaaggttccttggttctggtccatcttccatcttcatctattcttccttttaccagtctattaggcttgtctctctctcctggtacagaatctttcctttctttttcttgtgctatgggaagtcatgacttcaccaaaattagaggagcgttcncgtctaccttgatctttgattgcacaagagtatatgattgactaaccatgaatgattgtcttcctttttccggtctcttcctttttttatttaatgtttcatcaagacatttttctatgtacaattatgggattgtttcattttgcttcctgctgtgaacttaatgctaactatgatgttatttgcaggtttttccatttcgcttcgtggatgatgagagggattatctgtgcttgacaaaacggtatcccagacttgcagttactccagaattttctaaggttgggcattctgttcatctaccttttgttgctgatcgatattcaacttggcttttggcatnctctgtcactctaatttgtataatttgctgttgcacagattgtcntgaactgggctaaagaaaacttaaatcttcctctcgatacaccagtgaggtattccttttatttatgaacacattactatgcataaatactgttatacatgtgttccttcttggagttctcatgtttccaattaactgtacaattggcactatgatacaattgctgtgaaccagtttggagcatgatatccatgattcagatgataatgctgatgaaggagcaattatctccactgagaaaacaccaagcttcaatactccagccaccatttggaatgcaaaggtctctatctacagttttatatctgctttttaggaattttgttttttctgtatgcgtttcaagttgtagctctagtggtcagtagataagctgatctggagtaacttgttatactgtcgtacattgtatacgtgaatctgaaggaaacatatggcatatagttttaggtctgtttggatgttgccgaagaccacattatttgaaaatcacagcaatatttatgnnnnnnnnna

SEQ ID NO: 1107 - DNA, 434 bp, Zea mays
  misc_feature (297)..(297): n is a, c, g, or t
  unsure (1)..(434): unsure at all n locations
aaagttgttttctttgttcgatgaactaaataatgagtaaatttcagtgaactatgtgactggtcctaaagataattttagcttaacccatatccaaaaccacacgtgtgtccatattaccacgaactacgctttgtaactagaataacaacattgatttggatgtggactgacatactgggtccattgtaaaacagttgcagctcacagactaacagtgtcatatactcatatatgtctaggcccaatatgtcattgacatttgaactaacagtgttagctaacacgttcattttntctatcatatgaaatgaacaaatattatgtagcattgagcctttgagaaatttgttcatatttttttgataatctagactatatatatatcgtttagttattaccagtaattactgaagatcgttcagtaattacca

SEQ ID NO: 1108 - DNA, 538 bp, Zea mays
  misc_feature (110)..(110): n is a, c, g, or t
  misc_feature (206)..(206): n is a, c, g, or t
  misc_feature (208)..(208): n is a, c, g, or t
  misc_feature (241)..(252): n is a, c, g, or t
  misc_feature (283)..(283): n is a, c, g, or t
  misc_feature (342)..(342): n is a, c, g, or t
  unsure (1)..(538): unsure at all n locations
gccatctcttcgcggctgctccacggtggggagttcttcgggtcacgaaacgccgccgtctcgccggaggccagaaggctctacgagctcctccaacgccggcagcctancatgcaaacgttcgacttcaagggctacagtagtggtagtggcctcaggtacttaattaatcaccagaccgaaatgaagagcagaatgcgcacccnancttctatcatcctgtgaccacgcgaaactctannnnnnnnnnnntatctatgcatgtagggatcaagagtggagnttcagccagcatgcggcggcggcggcaagggctggggccatcaatggccacggcccgangaaagggctcatccacgatatgggtttgagaaagaacggcaggccgatgtcccatttgttcgacgtgcgggatcgggatgctatcgcttccaaccggacatcgtccgacgccacgggtgctgccagccacggcgtaacgatcaccagaagcgcagatcggaacagcacttggccccagcctaggacaatgtcggca

SEQ ID NO: 1109 - DNA, 619 bp, Zea mays
tggggtggacctcgccacttcagctcgtctttgcagttgccacgctcttctgggcactcaagcttggggctcttcctggtctagtcccgctagtcatctttggtttcctcaacgtgccattcgcgaaaatgctgcaggggtaccaggccaagttcatggttgcacaggacgagaggctccggtccacgtcggagatactcaacagcatgaagatcatcaagctgcagtcgtgggaagacaagttccgcagcacgatcgagtcgctcagggacggcgagttcaaatggctgagggagacccagatgaagaaggcctatggtgcagtcatgtactggatgtccccgacggtcgtctctgctgtcatgtacacagcaacggccatcatggggagtgctcccctgaatgctagcacgctcttcacggtcttggccaccctgagggtaatgtctgagccagtgaggatgcttccggaggtcctcacaatgatgatccagtacaaggtgtcattagatcgaattgagaagttccttctcgaagacgagatcagagaggaggatgtaaaaagggtaccttcagatgactctggtgtcagagttcgagtccaagccggaaatttcag

SEQ ID NO: 1110 - DNA, 639 bp, Zea mays
  misc_feature (248)..(248): n is a, c, g, or t
  unsure (1)..(639): unsure at all n locations
tagagcctaaatgttcccttggtaggcggatttttagaatactggtttgatggggcagaaaaacatcaaagttgccattatttaccagctataagtagaaattcctgccttatctctgcttccctgcagctatcctatttattcttgtggcggttcctctgtaccaatttgatatttgaatctgtttgattgttccccatccgcaatttcttctatattaagggccagtgtgattgcaggttaagttnttcctgtatcctgtctcttccctgctgcatattgtatattgttatgacaggggattgggacttgaggtggtttggagcctgaaaatgtttctggttccccaaactcatggtctgaaattccatattgttgtttaacgtcactatttgtattgagttttactgtagtctacattttgcattgtaaagtagtactagatctaaagttttatgccctgctcataattctatggtaagctaaatccacataactaggtgatcaagatttcgtaggagtagcaaagcatgcccacagtatgttgtttgttgtgaccttgtcgacctatcatgatttcatctatgacatgaaacaatgtatgccacagtttctgatctgtctccactagtttgctca

SEQ ID NO: 1111 - DNA, 1151 bp, Zea mays
  misc_feature (106)..(106): n is a, c, g, or t
  misc_feature (283)..(283): n is a, c, g, or t
  misc_feature (1138)..(1143): n is a, c, g, or t
  unsure (1)..(1151): unsure at all n locations
aatgattgtccttccaattacttcatcctttcctggggccaccctgtcctctacactcaaaactaggtgctcttcaaatggctcagctgcaacaaacatcaagtcntcattccacaatggattcaaagtccggcttgccaatgccctggttctttggacttggttgcctagcattgctttgacataaacttcagggaacctagtcttgtcatttggtataagatcctgggcttcaatgacatttacacggagataccaaagctttggagttagatacactttngacctaatgcttgcaaggccatcaccagggacggaggctgcatcagaatgccatgcttcagggaacgcttcatcagcttgagtacccatccaaacagccagcatcaactcccccttcaccttgtgcccattgcggtcttccaaccgataccattgtggagccaatgggctatcaggtggcactctctttgggacctcattcaaatcaaatataacacgtccaatgaagtcatccttgacaagatccttgtccttgaccagaatctccacaactgatgactggatgcgctcctttgcaaaggcaaagacctgattccactccgggttgttcttcttctcgaaatgcccagtctggcccttataatttcctagtttcacctcaacataaggatcacaactcccagtgatgtccttgttcggaagttcctttgcttttaccactcttacataaaggtactgcatctgctcaaccaggtcatatgtggttgtgagcttgtcaccagcagctgcaccaccaaggtgaggtgtggtttccttcaaggagtactcctccggacggagcggtggcctctgcatcatcttgttcgaagacaagcttacaccaaacttctactcacggacttgacaaagtgccaagaaaacccagtcgtcgcttgtcctaagaaaagtaaacagctagctttagatagttgctacaaggaaagaacattaatgaacaataatatgaattaagatgaaactactacctctgcaacaaacttgtcgtgctacacggcttaagagtattttgaacagttcctcatcttgctctgcggggggggaccatttgaattgaagagaatgacctccacatcannnnnnaggggaaa

SEQ ID NO: 1112 - DNA, 543 bp, Zea mays
  misc_feature (470)..(472): n is a, c, g, or t
  misc_feature (474)..(479): n is a, c, g, or t
  misc_feature (487)..(493): n is a, c, g, or t
  misc_feature (495)..(499): n is a, c, g, or t
  misc_feature (502)..(509): n is a, c, g, or t
  misc_feature (511)..(517): n is a, c, g, or t
  misc_feature (522)..(531): n is a, c, g, or t
  misc_feature (535)..(539): n is a, c, g, or t
  unsure (1)..(543): unsure at all n locations
ctgcagtacctttaccaacatgatgcttttgtttttctataagcatgtgtggcacactagttatcagctccgcaggaactacatcagcattgtgaaattcatcggtagtggactgcctagttgaagtcatatcgttgttttcaaaattagcagccttgcttctggaaacattcgactcagtgctagacaagcttcttctcaagaagccccttcccttcatcttgaggacaccaccacccttttggtccattgatggctggagaatcttccatgtctcttcccaatagttgggtgtagacaagagagaacttcctctcgatgaggatgaaggaagatttgcttcaagggcaaaagattgcagtaacttggctttctcaattaagctctttaagtcaatatcttctggaaaatttaacaacctcactaggcaagaagtcgcatgttcactccctaataaggaggatctgagnnngnnnnnnattgatannnnnnncnnnnnaannnnnnnncnnnnnnnagaannnnnnnnnntaannnnntaat

SEQ ID NO: 1113 - DNA, 679 bp, Zea mays
  misc_feature (87)..(87): n is a, c, g, or t
  misc_feature (439)..(439): n is a, c, g, or t
  misc_feature (531)..(531): n is a, c, g, or t
  misc_feature (573)..(574): n is a, c, g, or t
  misc_feature (606)..(607): n is a, c, g, or t
  misc_feature (609)..(609): n is a, c, g, or t
  misc_feature (614)..(614): n is a, c, g, or t
  misc_feature (616)..(616): n is a, c, g, or t
  misc_feature (624)..(624): n is a, c, g, or t
  misc_feature (631)..(633): n is a, c, g, or t
  misc_feature (636)..(636): n is a, c, g, or t
  misc_feature (643)..(651): n is a, c, g, or t
  misc_feature (654)..(657): n is a, c, g, or t
  misc_feature (659)..(663): n is a, c, g, or t
  misc_feature (669)..(670): n is a, c, g, or t
  misc_feature (675)..(675): n is a, c, g, or t
  unsure (1)..(679): unsure at all n locations
tgcagcctcatctactcgtcgccgttcctccattcccacctcctcctctccccgcacctccccttcttcgccttcgcggtcccttcngcggggtacctcctcctgctcgaccccaccaggcaggcgccttcctggtcccgcctcccgctgccgctgcccgctcccggcgctggccaagggttctccccggcggccgcgtcggcgggcctgctcgcgttcctgtcggacgcgtccggccacaagacgctgctcctcgccaaccccatcacgcgcctcctcgcgccgctgccgctctgccccacagcgcgcctctctcccactgtcggcctcgccgcgggacccacctctttcatcgccgtcattgccggcgatgaccttgtgtcccccttcgcggtcaagaacatctccgcggacacattcgtcgccgatgccgcctccntcccgccctccggtttctgggccccaagttccatcctgccccgcctctcctccctcgacccccgcgccggcatggctttcgcgtccggaagntgaagtcacaagtctcaactctcaagtgcacgtgtgtgcagnntgtgtaacactatgcatacacatgagcacacnncntgagntnaaactgantacatgnnngtnctactgnnnnnnnnnctnnnncnnnnnctactnnatganctcg

SEQ ID NO: 1114 - DNA, 718 bp, Zea mays
  misc_feature (365)..(365): n is a, c, g, or t
  unsure (1)..(718): unsure at all n locations
ttttttttttggccgccgaagcctaggctaggtgaatgaaggctgcaaccaaacagcctcttgatgataacgaaaaatgaaaagggcagttcaactttatttctcaattctttaccagtttcctttttattttaaagtacaatagtctctgcaatttatctgcgaacaacaagaagaacaatttccgagcttctgtacataacatagccgtgactacttcccaccaaaacacaatggtctccgacacaaacaattaatacctccaagaattttgtaaatttctgttacacacacgattgcttatccaaaatccatcaagtccacaccttaaatacaaagaagaattacatgcattgcatatgcanaatcatatacaaaaattaggaaatagggagcacaacctcacccttaaaaactgttggcattaattaaacaataataaaatggaaataatgatgcgcaaggatgcaaggagaaattgcgtacgactggaatcggagctcgtcttccgggacgctgtcgatgaggttgatctgatcgtacaacgagaaggtcctcctgctcatatccgcgtcccaaacaaatcagataagcaccagaggagaagaaaagcaacaagtcacatttcctcggtccagcaggagccagcgtatacctgagagacggaaggcgcctgagtcgtgcgctgccggagacgggatcactccgcagcgacttc

SEQ ID NO: 1115 - DNA, 707 bp, Zea mays
  misc_feature (1)..(2): n is a, c, g, or t
  misc_feature (37)..(37): n is a, c, g, or t
  misc_feature (586)..(587): n is a, c, g, or t
  misc_feature (619)..(623): n is a, c, g, or t
  misc_feature (633)..(633): n is a, c, g, or t
  misc_feature (635)..(635): n is a, c, g, or t
  misc_feature (648)..(654): n is a, c, g, or t
  misc_feature (663)..(664): n is a, c, g, or t
  misc_feature (666)..(669): n is a, c, g, or t
  misc_feature (673)..(673): n is a, c, g, or t
  misc_feature (679)..(680): n is a, c, g, or t
  misc_feature (682)..(685): n is a, c, g, or t
  misc_feature (690)..(691): n is a, c, g, or t
  misc_feature (697)..(699): n is a, c, g, or t
  misc_feature (701)..(704): n is a, c, g, or t
  misc_feature (706)..(706): n is a, c, g, or t
  unsure (1)..(707): unsure at all n locations
nncaatgcttgtcctgttttctttgcctcagtaagtngtatctttgtatattttgctttgccagatacaggctgtaaaatgtaggcatgctttttcgaagcagatctggaaccatcctgctcctgaaactcaaaaacctgaaaatgtagtttacaaaccaataaatatttgttaggttgctggatgcaagcaacagaagaataaaagatcccaacaaaacctcattacagcactgcgtctattcacactctaccacatgttttttcaaacagaaattgacaaaggtaattgtctccatgccaatttattctctcaaacccagggtatttatttgcgcacaaacaaaattgggaggcacctgactccactctgatggaagtaaatcctcccagggtttatccacaatccaagaactgctatcagagtcaaaatacaccgccagactctcaagttcaacagactgcaaaatgccaagttaaagaagtcacgcaaattgatcaaaagtaaaaaaggtcaaactaaaacaaataagcacaccaaatgtgaaaaatgcttgatgtgtgaagcgaaaagaattcattactanntcctgaaaactttaaatcaaattaattgatcnnnnnaattagaaantnaaaaatgagctannnnnnntttttactnncnnnnctantattcnncnnnntagannatgagnnntnnnnant

SEQ ID NO: 1116 - DNA, 553 bp, Zea mays
  misc_feature (542)..(542): n is a, c, g, or t
  unsure (1)..(553): unsure at all n locations
tgtacgttatacaacagctcggcgcatgtgtctgtatgcattatgcaagcacatgcatgggcatctaccgacgaccacctacaatgctgcggtggtggcggcgcccttggcctccgccgccttcctctccttggcggcgtcgacaaacccgacgtacaggtccgagtgccccgtgtcacaccgcggcagcgctggcctcgcgccaccgtcggccatagccctgacgaaggacacgaaccgcccccagttgtcgccgtcgaagagcgtcttgttcatgcgcagatacgtgaacgcggccaggcctgcgccgcgcgccgtcgacaccacctgcgagaacgccgcatcgtcgtaccgctccagcgcgttctcgccggcgagctgcacgccggcggcgctggtcgcagccttgacctgctgcaccagcagctcgggggagcagctggcgtgctgcggctgctgctcgtccttcatctccatgcacgtgaagttgagcacagcgccgcgcttggccagcatgcgcgcgatcggcgcgtacccgtcgnggccccgcgtg

SEQ ID NO: 1117 - DNA, 671 bp, Zea mays
  misc_feature (606)..(609): n is a, c, g, or t
  misc_feature (631)..(644): n is a, c, g, or t
  misc_feature (647)..(660): n is a, c, g, or t
  unsure (1)..(671): unsure at all n locations
tatttaatactacatgctttctcttatggaatgtagcatttcagtttctaattgtatcggtcttgctgtttggttagtttaatatttaatacatgtttttctcttatggatgtagcatttcagtttctaattgtatctgtactcctgtttgcaggagagcaaagcagctgttgccccaaggaccatatgctacctgataaagaaagctaagagcgggtggtggccaaggctgctgaagcaggagggcaagccacctgtgttcttgaaggttgactgggacaaatggcaggacgaggatgatgaagatgctggatgttagtgtttcatttttggttgattatgttttcctttccttactactgcaatactatttagtttagcttgaagtaacatatattattcgtattgcagttaatgactttggtggtatggacttctcggtaagtgtctagtggaagcctcctttgacgattaaggtgggagcaaagtttcatggtactttcgtcattgtagaaactggacataggaggtgctgatgacgacgatattggggatgatgaagatgatgtggttgaaagtgctaacaaaggtacatcgttctcgttnnnntcatgattatttatttgctcannnnnnnnnnnnnntgnnnnnnnnnnnnnntttacactatc

SEQ ID NO: 1118 - DNA, 519 bp, Zea mays
gaaggtccatcgcaaatccaacctgcaaaggctgaagatgaatacgatttcttgcacgacggcagaaggcaggccgaagccaggctacagagagcacttgcccgggtgcactctatgtcacagtacccagaagcgagagagcagtaccacaggcttacaacctgcgttgctgaaatgaaacagtccagggtatggtttgatcgctcgctcctatgctttcgaagcttgctgcaggacgtgttttattttccctcggggtttgatcatgatttgatgctggctactttggaacagatgatgcaggatgagatgctaagccaggcggctggtggtgcggacgatttcatggctggactggaggacttgatctgcatagatgatgccccgccccgatgtctgccattcggtgaagctgagcctttttacatcagataggcagggaggcggtttccttgctccccttttgtcagactagccctgtaaatattcttcagctagttgttcaccccgactgtttac

SEQ ID NO: 1119 - DNA, 658 bp, Zea mays
  misc_feature (202)..(202): n is a, c, g, or t
  misc_feature (223)..(226): n is a, c, g, or t
  misc_feature (229)..(229): n is a, c, g, or t
  misc_feature (245)..(245): n is a, c, g, or t
  misc_feature (282)..(282): n is a, c, g, or t
  misc_feature (333)..(334): n is a, c, g, or t
  misc_feature (445)..(445): n is a, c, g, or t
  misc_feature (453)..(453): n is a, c, g, or t
  misc_feature (465)..(466): n is a, c, g, or t
  misc_feature (534)..(534): n is a, c, g, or t
  misc_feature (591)..(591): n is a, c, g, or t
  misc_feature (606)..(606): n is a, c, g, or t
  misc_feature (647)..(653): n is a, c, g, or t
  unsure (1)..(658): unsure at all n locations
cctaccttctgatcctccggctagctagctacttcaaatccccgccgctgcgctgcgcatgtgttcacgctctaaatacgatggcatatgcatgcatgcagaacggagtccgggcgctgatgctcgacacgtacgacttcaagggagacgtgtggctgtgccattcgagcggagggaaatgcaacgacttcaccgcgttcgngagtacgctggctcgctctgnnnnaantgaacagggcgtgcgnccgtacgtctcaaagctgagcatttgtttttgggggntcattgtaggaacctgcactggacactttcaaggagatcgaggcgttcctnncagcaaacccgtccgaaatcgtcacgctgatcctagaggactacgtccacgcgccgaacgggctgacgaacgtgttcaacgcgtctggcctgctcaagtactggttcccgntgtcgagnatgccgccgagnngccaggactggcctctcgtcagcgacatggtcgcgaccaaccagcgcctcctggtgttcacctccgtnagctccaaacagagcgcggaaggcatcgcttaccagtggaacttcatggtcgagaanaactgtgaggcatcncgattggttcctgctttctatctatcttttttttttctctnnnnnnntgcag

SEQ ID NO: 1120 - DNA, 794 bp, Zea mays
  misc_feature (64)..(64): n is a, c, g, or t
  misc_feature (678)..(679): n is a, c, g, or t
  misc_feature (725)..(728): n is a, c, g, or t
  unsure (1)..(794): unsure at all n locations
caggattatgtgttaaatcgcaagagtactagtacatgcttcagttgctttagtatatgtaaangagtcaacaaaaagtattcagtacctgtggtgaaattcagagtatggggtatcagcttgtagggtggacaggtgctcctcagccttcctcagcgcaccttgcagagcactgagactgcggattctgtcgttcaacatcatggtctgtagggaaccatagaatttcagatttttccagctagttcaaagccaatttacaactaccacagcaggaatatatggataaatagtttaaggtgtccttgtggttaaaaattttagacagctcagcaactcattatttatcgggtatgcatcacaggtcagccttaatgatacaaaatttccactttgctaacacccttttgacaacttctagacaatatcgatgacatttaagtaaagaaacagataaaacaatggctcaccatccccttgtagttgtgggcgcgaaggaagttgagcaaggggtacatgctctccttgtcatggaagagctttgatgacaggtgcctgttgaggaactgcacgccattgccaatggactttgacagagaaggacgggggaaggaggcattgaatggctcaaagtccagctcaagaacaaagttgttgttggggctgcaatatatacannaaaagtattataaactgtcatatatatgaccaaaaccttttatttnnnnaaaagtatattaatcatggtatattaatcaaagttgttgttggggctgcaaaaatcatacccttct

SEQ ID NO: 1121 - DNA, 649 bp, Zea mays
  misc_feature (587)..(587): n is a, c, g, or t
  misc_feature (595)..(598): n is a, c, g, or t
  misc_feature (607)..(612): n is a, c, g, or t
  misc_feature (616)..(617): n is a, c, g, or t
  misc_feature (630)..(630): n is a, c, g, or t
  misc_feature (632)..(635): n is a, c, g, or t
  misc_feature (642)..(643): n is a, c, g, or t
  unsure (1)..(649): unsure at all n locations
catgcctgcagttacattctttgctcgttttaacgggtgttatatgtgcagtgggtcttactatacactgtcctgatagagcatatcaaatgccttcttttgcttagatggtagtagagttctgacccaatttccactaaaagatccagagcaagacttgcattctgtaaccgccattttacaagcagaatcaggatacgtagaagtggttttctacacttatcatgactcataaatatccattgctatactaggatgcgagtgagatctccccagcgcataacttatacccttgcttcttggtttgtaggcatattttatcatcctagctatgcatgtagtacagtttaaccctttcatttattgagatgacttttgatgttctgtctgtttctgtaggttgttcatgatgttgcagcgttttcctgtagaatcaaaaggaagacgaaagaaattgcaggaggtacgctttggattctgctggtctgaattttttgggggtatttctgtacaaattatacgctaattatgtattctgcatacctctatacaggttgggtatgtgactaccatatgcttttcttgtntcttgatnnnntgcgtcatnnnnnncacnngcattttctttgnannnntcatcannacttac

SEQ ID NO: 1122 - DNA, 660 bp, Zea mays
  misc_feature (349)..(349): n is a, c, g, or t
  misc_feature (397)..(398): n is a, c, g, or t
  misc_feature (400)..(401): n is a, c, g, or t
  misc_feature (491)..(492): n is a, c, g, or t
  misc_feature (498)..(502): n is a, c, g, or t
  misc_feature (527)..(527): n is a, c, g, or t
  misc_feature (552)..(556): n is a, c, g, or t
  misc_feature (575)..(575): n is a, c, g, or t
  misc_feature (584)..(585): n is a, c, g, or t
  misc_feature (592)..(594): n is a, c, g, or t
  misc_feature (597)..(628): n is a, c, g, or t
  misc_feature (630)..(656): n is a, c, g, or t
  unsure (1)..(660): unsure at all n locations
ttgggtcttctccaccgatgagtaattttgatccagctaaaatgctcactgtaagtcttcatcacttctgttgactgttgtgctatgtggcacagttgcacatttttgtttatgtttgctctctcacgtgctgacctgcataatttcatcacccttttaggcttgtttggacgtttagtttagttccttagattaagttaaatttgaaccgagggttggaagttcctagaagaaatccctcatccaaatagaggtcccaagttatcatttatatcaatgtggatctgaggtgccttttgaactcttagagctcaaatatgtcttgggacaatttggaatgaagtaatgnactcctttacataaaggccaaaacaatttctgtttttattgcaccttnntnnagttattgtggtactgcgttactatatgtagtgcttgatgacaggattctgggaagctccacaccttggatatgctactacgacgccttnnagctgnnnnncatcgtgtgcttctttttgctcagntgactaaaatgttggacattcttgnnnnnttactttatgctacatgtntactatttnntatgtgnnntannnnnnnnnnnnnnnnnnnnnnnnnnnnnnnnannnnnnnnnnnnnnnnnnnnnnnnnnntata

SEQ ID NO: 1123 - DNA, 711 bp, Zea mays
  misc_feature (595)..(595): n is a, c, g, or t
  misc_feature (613)..(614): n is a, c, g, or t
  misc_feature (628)..(630): n is a, c, g, or t
  misc_feature (639)..(643): n is a, c, g, or t
  misc_feature (655)..(655): n is a, c, g, or t
  misc_feature (657)..(660): n is a, c, g, or t
  misc_feature (666)..(666): n is a, c, g, or t
  misc_feature (686)..(690): n is a, c, g, or t
  misc_feature (693)..(699): n is a, c, g, or t
  misc_feature (706)..(708): n is a, c, g, or t
  misc_feature (710)..(710): n is a, c, g, or t
  unsure (1)..(711): unsure at all n locations
aatgatgggcaaatcagtattaagttcttgtatcaaaggatgaggagcaattggttgtctaggaccattgaactcagaagtacgagcaaatcccaggaacagtttcttggcccaaggatcatacatctcatcggtgaacttataggcaaaatttcgatcagcacaccaaacatttatctggtgaaggggaaagggctgttaatgaacactgacaatatatgtgataaaaacagatagatgtaaaagaacaactcttacaatacttggaggttccaaactcttttaacatttagagcaaaaaatgtactcagatgactatagacactgatggcctcatgcaatgcaatatacaaaagaaacccacatggacaagacaaatggactcacaggtggtgctctagctggcggaataaaagcatatgctgaacgaagaagcctaatgtttgaagcgagcctgtcgcgatgagaaagcaccagtgcttcatatgggccatcaattggcccagtcccaatctttgtcctaagcaaactgggcttgacctttgtagaagaaagcaacaaacgggcaactgcacgaacttttgtggaatcattntgactggactggatgccnntatcttctgaatcnnngaattcatnnnnnatttcagcagtntnnnncatatnccattgcattactgaaaagnnnnntcnnnnnnncaatgannnant

SEQ ID NO: 1124 - DNA, 639 bp, Zea mays
  misc_feature (449)..(449): n is a, c, g, or t
  misc_feature (634)..(634): n is a, c, g, or t
  unsure (1)..(639): unsure at all n locations
tttgttacctaaacatggagcagctaacaaaatgcctgctttctctgtatgatatgtatcatgtacttcataagtgtgattcacacagcaaaaaggaggctgagtattattccttctatgtgcttctacatttgggatgcaagatacacaaaatggtaatttgttttccctttctcacttcttccatgttcaaatttgttcttaatccttttcaagagctttatgctttaccttactccaacttgtatccaaaattaactttctatttatcttcagatagattcactctctttgtggtatggtcaattggctactccagtcagacggtcaaaggaaatgatatttgctagatctttattaaggtaacatctagacgaattgattgccaacatgaaccttcattctttgcatgctcctatttctgttcacatagttaagcccagagtctntatgtgttttcattttctctatgcctgaccacttgtatgatttggtcataagtacttattgttgattcatagttggctacttcagtgctgagccatgttgttttaaatcttagataattgtatatatcttatgtagatgctatcgcctaggaaacttcaagcgtttcttttgcatggtagcaggngtacc

SEQ ID NO: 1125 - DNA, 1212 bp, Zea mays
aagaatgaaatgatcctggtctatgattacatggctcatggtactctccgcgagcacctgtacaagacccagaagccacctcttacctggaggcagcgtttggatatctgcattggtgcagctcgtgggcttcactaccttcacactggtgcaaagcacaccatcatccaccgggatgtgaagacaacaaacatccttctggatgagaaatgggttgccaaggtttcagattttggtctgtccaagactggcccatctatggaccatactcatgtgagcacagttgtcaaaggcagtttcggataccttgatcctgaatactttcgcaggcagcagctcacagagaagtctgatgtatactcttttggtgttgtgctgtttgaggtcctctgtgcacggcctgccttgaaccctactcttccaaaagaggaagttagcttggcggagtgggcgttgcactgccagaagaagggcgttcttgatcagattgttgacccctacctgaagggaaagatagctccacaatgcttcaagaagtttgctgagacagccgagaagtgtgtttctgatcagagtattgaccgcccttcgatgggcgatgtgctctggaacttggagtttgcccttcagatgcaggagagcgcggaagagagcggaagcctcggttgtgggatgtcggacgagggcactccccttgtgatggtcgggaagaaggatccaaatgacccgtcgatcgaatcgagcaccaccaccacaaccaccacttctttgagcatgggcgatcagagcgtcgcgagtatggactcggatgggctgacgcctagcgccgtcttctcacagatcatgaaccccaaggggcggtgaggtaaagctggtcccattcgttaccttgcattcattcagcatgtttttttcacgagttcgtgctgttacggttctctcgaattaagaaccagacgtccgagaattgtttcatactagatattctgccttgccctatacttcttccccagtattgcaacgactgtacatctgttggcttgtattgtaccgctgctattgacccaactagtattttactttatgagaaagtgatgtgcacgaactattgttatgagtggtcgtgtgacgtgctgttaggaaggagtctcgactctgaattcgacatgcacacttgataatcagttttcaatctgaatgggttgcgagagc

SEQ ID NO: 1126 - DNA, 336 bp, Zea mays
gaactgactcccaggggagatacccccggggaggtcattgctcccgagcccgcaaagcttcctgccgctacaaagcctttggtcaagctggggtcggaggaaaggtcattggtctctccaggaagatgagacggtccgatgcttccgttctgtatagttccatggttcttgatgtgtacaggttgtagcttctcatggtagcagagtgcaggctaaggttttttacatgtgaagcctgcccacctgtcgtcccgtagtttggctcggttgtactagcaggtagcaataagtggtgctgtggagctatgtcttagggaaatcgtatggtagttgcat

SEQ ID NO: 1127 - DNA, 635 bp, Zea mays
  misc_feature (90)..(91): n is a, c, g, or t
  misc_feature (94)..(95): n is a, c, g, or t
  misc_feature (449)..(449): n is a, c, g, or t
  misc_feature (492)..(492): n is a, c, g, or t
  misc_feature (542)..(548): n is a, c, g, or t
  misc_feature (557)..(558): n is a, c, g, or t
  misc_feature (578)..(588): n is a, c, g, or t
  misc_feature (595)..(633): n is a, c, g, or t
  unsure (1)..(635): unsure at all n locations
cctgtctctgccgactgcggacatactaggtatgcaagacagcaacccaaggtatgcaagatcttaagcacacccacgcatacacacacnnctnnctatgactctctatcctggcttgggatcttgcactagtagcagttaaaatagcttacagacaactgccatggtcatgtgcacttctacagtcactgggcctccctagtggcctagtagtatacaatatctgatgaatctcgcagcaggctgtagctgtactgctctttacatgtgacatgtgcctggtaccagaatcgtggattaacctcgcatttagtataataaacctagtgggggtggggtgggttggggggcctgtcattgtagagtacatcaaggacagtgtcacagtaacatctttgtgctcatgttacctgcctgctactggtaaacattaagtacagatactattntatatatctctctctaaaaactagtggtgacactggattattngtatatataatatatatatacttatatctggcaatactgcatatgctgcnnnnnnnttaatcaannctaatggcatcttcttctcnnnnnnnnnnntagaacnnnnnnnnnnnnnnnnnnnnnnnnnnnnnnnnnnnnnnnac

SEQ ID NO: 1128 - DNA, 731 bp, Zea mays
  misc_feature (31)..(31): n is a, c, g, or t
  misc_feature (220)..(220): n is a, c, g, or t
  misc_feature (269)..(269): n is a, c, g, or t
  misc_feature (316)..(316): n is a, c, g, or t
  misc_feature (334)..(334): n is a, c, g, or t
  misc_feature (478)..(478): n is a, c, g, or t
  misc_feature (547)..(547): n is a, c, g, or t
  misc_feature (562)..(562): n is a, c, g, or t
  misc_feature (567)..(576): n is a, c, g, or t
  misc_feature (582)..(582): n is a, c, g, or t
  misc_feature (584)..(585): n is a, c, g, or t
  misc_feature (594)..(595): n is a, c, g, or t
  misc_feature (604)..(604): n is a, c, g, or t
  misc_feature (607)..(618): n is a, c, g, or t
  misc_feature (621)..(630): n is a, c, g, or t
  misc_feature (632)..(637): n is a, c, g, or t
  misc_feature (640)..(644): n is a, c, g, or t
  misc_feature (666)..(667): n is a, c, g, or t
  misc_feature (670)..(676): n is a, c, g, or t
  misc_feature (678)..(679): n is a, c, g, or t
  misc_feature (682)..(730): n is a, c, g, or t
  unsure (1)..(731): unsure at all n locations
catggtgttcttgtccaccccgccgtggccntcacccgacaaagctaccaatgcggcgactagaccagcgttgcccgccagcgttgcttcagtgtagttgtagttcctgcgggcatctttgaacccgtcatggcggtcggggccagcaaccatggcacctgctatggtattagggtttggcttcttggcgtccctccacttccaccctcctttgcagccntagtgaacaccgttcttagggatcgaggcgccccggtggtgaacatgcntggggtaacgctttccgaacccaaccacgtagctcatcttcaaaggnttctttcctaagatgtantcgatctgatggaagtagctagttaattagtatatatcagaagttaaacactgctggaacgacactgttgtattaaaatgctggcagcctacctgagtccttgcaaaactgcgaagaacctcaacagagtagaaatgggggccncaataccacccaggagtatccgcagcctcaagatagtcactgaacacagaagcaaggaatgcagcgttnaccacatactggagnggccnnnnnnnnnngtgatntnnctggatcannccacctgtnatnnnnnnnnnnnnagnnnnnnnnnnannnnnngcnnnnntgacagtatagtacactgactnnatnnnnnnntnnatnnnnnnnnnnnnnnnnnnnnnnnnnnnnnnnnnnnnnnnnnnnnnnnnng

SEQ ID NO: 1129 - DNA, 906 bp, Zea mays
  misc_feature (174)..(174): n is a, c, g, or t
  misc_feature (219)..(219): n is a, c, g, or t
  misc_feature (640)..(642): n is a, c, g, or t
  misc_feature (645)..(645): n is a, c, g, or t
  misc_feature (663)..(663): n is a, c, g, or t
  misc_feature (668)..(668): n is a, c, g, or t
  misc_feature (884)..(897): n is a, c, g, or t
  unsure (1)..(906): unsure at all n locations
agcagcacgacaggtagagaagccgcctttacaagttctgagttctgaccccgaaactcgaatcattcgcaccaaagctccagcctttttcgcatgttcgcgtgcagagccgcggcggccgcgtctctgatgctgggcggcggcgacgaggcgcacaagttcatgggccggccncgcctggaccgtgctgacttcgcgaacatgatgaacccgggctcncggcagatttacctgacattcccggccgacagcacgttccgcgaggaggacgtctccaactacttcaggtatgctatgcatgcacacatggtaatgtgattgatgctgcaatctttgcttcggtagaagaaccccgtttggttggttgaccctcgcgcttcttggcaatgcggcgcagcatctacggtccagttcacgacgtgcgcattccctaccagcagaagcgcatgttcgggttcgtcaccttcgtgtacccagagacggtgaagctcatcctggccaagggcaacccgcacttcatctgcgacgcacgcgtgctcgtcaagccctacaaggagaagggcaaggtccccgacaagtgcaggcatgcactgcgagttcatcctttgcttgctcccagcgaccgcaatggcggccgccnnnctncgtgcatgcagttgctcnggggnttgactgatttgctgttctcgctccgcaggaagccgcagcaaggggacttctccggctgcacgacgcccactggcgggctggacgccgggtacccctttgatctgcaccagctcggtaaaaggaccccccagcgatgtcctcttgatcttcggttggccgtgttggcgaacttgggccagtcgttgatgcctgtgtggttttttgttgtggtgatnnnnnnnnnnnnnnatgctgcag

SEQ ID NO: 1130 - DNA, 975 bp, Zea mays
  misc_feature (24)..(24): n is a, c, g, or t
  misc_feature (30)..(30): n is a, c, g, or t
  misc_feature (72)..(72): n is a, c, g, or t
  misc_feature (76)..(76): n is a, c, g, or t
  misc_feature (106)..(109): n is a, c, g, or t
  misc_feature (111)..(111): n is a, c, g, or t
  misc_feature (142)..(142): n is a, c, g, or t
  misc_feature (144)..(144): n is a, c, g, or t
  misc_feature (150)..(150): n is a, c, g, or t
  misc_feature (172)..(172): n is a, c, g, or t
  misc_feature (190)..(190): n is a, c, g, or t
  misc_feature (211)..(211): n is a, c, g, or t
  misc_feature (244)..(244): n is a, c, g, or t
  misc_feature (259)..(259): n is a, c, g, or t
  misc_feature (301)..(301): n is a, c, g, or t
  misc_feature (340)..(340): n is a, c, g, or t
  misc_feature (344)..(344): n is a, c, g, or t
  misc_feature (360)..(360): n is a, c, g, or t
  misc_feature (376)..(376): n is a, c, g, or t
  misc_feature (385)..(385): n is a, c, g, or t
  misc_feature (424)..(424): n is a, c, g, or t
  misc_feature (429)..(429): n is a, c, g, or t
  misc_feature (474)..(474): n is a, c, g, or t
  misc_feature (484)..(484): n is a, c, g, or t
  misc_feature (487)..(487): n is a, c, g, or t
  misc_feature (491)..(491): n is a, c, g, or t
  misc_feature (556)..(556): n is a, c, g, or t
  misc_feature (562)..(562): n is a, c, g, or t
  misc_feature (616)..(616): n is a, c, g, or t
  misc_feature (635)..(635): n is a, c, g, or t
  misc_feature (645)..(645): n is a, c, g, or t
  misc_feature (725)..(725): n is a, c, g, or t
  misc_feature (736)..(736): n is a, c, g, or t
  misc_feature (805)..(805): n is a, c, g, or t
  misc_feature (807)..(807): n is a, c, g, or t
  misc_feature (851)..(851): n is a, c, g, or t
  misc_feature (892)..(893): n is a, c, g, or t
  misc_feature (897)..(897): n is a, c, g, or t
  unsure (1)..(975): unsure at all n locations
agctggaagaagagatggcccccntttatnaagtccaggacaaggtaaagtcggtacttcgtctgccaaaanaggngagtgattaatactggcaaaaaggatactnnnngngagatttgaacatggcaacaaagaataagcncntaaatnacaattgcctacctgaaaggantacctcagctgcacgacnaaaggatggtcaacctttgtnagtatatctctctcagctttcatgtactcagcntgattcttctccacnatcttgtccttcctcataactttcattgcatatatttcagangtacctttctttctcacctgatatactttgccaaatgcncctnggccaacgagcttcanaacttcgaagtcatcnagtccaacnccctcattctccttttttacatcatcaaactcatcatcnctaanggacccttggttgatttgttttcctttggaagggcactctgaaanttccaatganctntctntcttgtgtaatgtaagcttgctaaatggcaaagattgactaacaagagatgatggaccaacaagngaatgngatcgtttgacaatgacatcagggtcattgtaaacctcatcgttggactcagcnacaggtgctggactgcccngagtgagaanactcacttctgtgtgtgtatggacagcactaggcccaaaaacatcagaaaaatcgaactcaacattttcagaaggcacancatctgagganccccctggcagaaggatcttccctctaaaaagcttggagccctgtgcacgcgtcactgtgacagaggtnanctcagaggaaaccatcttcgagaacctatgagattccgcaagangactaggaagtcttgggccacaatttaaggaaggctccttnnacanattcccaagacaacggaagatgcagggctgcgaacaatggccttgaacaagtggaaattgacgaaaacaattgggaac

SEQ ID NO: 1131 - DNA, 1441 bp, Zea mays
  misc_feature (10)..(10): n is a, c, g, or t
  misc_feature (23)..(23): n is a, c, g, or t
  misc_feature (56)..(56): n is a, c, g, or t
  misc_feature (75)..(75): n is a, c, g, or t
  misc_feature (548)..(548): n is a, c, g, or t
  misc_feature (556)..(560): n is a, c, g, or t
  misc_feature (604)..(611): n is a, c, g, or t
  misc_feature (619)..(626): n is a, c, g, or t
  misc_feature (629)..(631): n is a, c, g, or t
  misc_feature (634)..(758): n is a, c, g, or t
  misc_feature (763)..(769): n is a, c, g, or t
  misc_feature (775)..(784): n is a, c, g, or t
  misc_feature (786)..(792): n is a, c, g, or t
  misc_feature (799)..(808): n is a, c, g, or t
  misc_feature (811)..(813): n is a, c, g, or t
  misc_feature (816)..(829): n is a, c, g, or t
  misc_feature (836)..(839): n is a, c, g, or t
  misc_feature (841)..(845): n is a, c, g, or t
  misc_feature (847)..(847): n is a, c, g, or t
  misc_feature (853)..(853): n is a, c, g, or t
  misc_feature (855)..(855): n is a, c, g, or t
  misc_feature (869)..(872): n is a, c, g, or t
  misc_feature (874)..(878): n is a, c, g, or t
  misc_feature (890)..(898): n is a, c, g, or t
  misc_feature (934)..(934): n is a, c, g, or t
  misc_feature (1308)..(1308): n is a, c, g, or t
  misc_feature (1391)..(1391): n is a, c, g, or t
  unsure (1)..(1441): unsure at all n locations
tagtgctccnaaacggccaagcntcaagccagattagtagaaaacatactaatgancaatagtgcaaaaaaatantacaaatacacccagcactaaaatgagatgagtgtatgtacctgtgcagcttgaaggtattaggcccataccggtgagtggtatccttttccaagtcttttggaaggttgatgatttcaatggcatcaaatgggcatttctgcaacagagattacagaagcaagaagtgcattacatcaaataggcacatcatacacagttacctggagtaagttagaaatctacctttacacagataccacaaccgatgcacagttcctcagaaatgaaagcgagtttcgacgccgaagtcacttcaatgcaaagcttccctaaacagtaaaacagaatattgtcataaaagtgatccatgccaagccagaaactagatgatgtgcagaacaacaaagggaagagaacaatatactgtatctatttcagcgaaatggatgatattgtatttggacactggaccttcacaagttacagtacgnactatacnnnnngcagcatgtgagaattctattcaattcactaaacaagagatatnnnnnnnntttctacnnnnnnnnaannnacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcnnnnnnnaaaatnnnnnnnnnntnnnnnnntgacgtnnnnnnnnnntgnnncannnnnnnnnnnnnntcatgannnnannnnncntactgnangtagcatttggttnnnnannnnntatatttttgannnnnnnnnttggttgtatgaaggaatgatcacggagcacggtancttctctagtgctcgacataactgatgagttgcactatggttgtctgacttccctcgtccttgatgtcaaagaaggatttggggatgcactttgattgttgggcaagaactgtggtgaagatgcagtagctatacggattatgcatctgtggccaccacctaaaattgttgaggtgaagcagtgtgatggagctatcgtcagtaaattggccaacctttagagattgttagtgtcataacagactatgattgtgttaggacatttcttatgcgagaagtcactcagcctcgcattcagtcaatactgtatgttgaaaagccctatgttttttacagtgaacattgatgtgaagcttcttcctgggaaatggctngaaccatattttaatgtgagatgttgctgatcttctactcaaaggctattgcaattttctgatatgaatttacaagggaatgntgtcctcgcactaaacaaaagtcaactgtgcaatatatatgaagaatgta

SEQ ID NO: 1132 - DNA, 386 bp, Zea mays
  misc_feature (93)..(93): n is a, c, g, or t
  misc_feature (384)..(384): n is a, c, g, or t
  unsure (1)..(386): unsure at all n locations
tattccagcctgtagtactgtaatactgttgttgaatggctccctgcatgtagaatgaagccaaccataccttctctggctcaagggtgcatncaatgcaacgcggaagaactgctcgtagcggtggagccatgacaacgggtctttggagccgtcgtacttggggaaacacagcttgtgagtggcggtgttgatgaaggcgctggtcctaccatcggccgtagaggatttcggctggaacacgggctggtgctgctcacatggcttcttgtagctgcccaccattgcttcggctggacattgttgacagtgatgtggagacaaccctgatcagccttgagggagacctcagtggacaggccggtcaccttatcctccatgtcnat

SEQ ID NO: 1133 - DNA, 629 bp, Zea mays
  misc_feature (95)..(95): n is a, c, g, or t
  misc_feature (361)..(361): n is a, c, g, or t
  misc_feature (514)..(519): n is a, c, g, or t
  misc_feature (523)..(526): n is a, c, g, or t
  misc_feature (535)..(545): n is a, c, g, or t
  misc_feature (547)..(556): n is a, c, g, or t
  misc_feature (567)..(571): n is a, c, g, or t
  misc_feature (573)..(577): n is a, c, g, or t
  misc_feature (586)..(587): n is a, c, g, or t
  misc_feature (591)..(592): n is a, c, g, or t
  misc_feature (595)..(595): n is a, c, g, or t
  misc_feature (597)..(599): n is a, c, g, or t
  misc_feature (601)..(608): n is a, c, g, or t
  misc_feature (612)..(617): n is a, c, g, or t
  misc_feature (620)..(620): n is a, c, g, or t
  misc_feature (622)..(622): n is a, c, g, or t
  misc_feature (624)..(624): n is a, c, g, or t
  misc_feature (626)..(626): n is a, c, g, or t
  misc_feature (628)..(628): n is a, c, g, or t
  unsure (1)..(629): unsure at all n locations
ggtgtttactgtgaccctgatccctcaaaacaagttgatcataccatcactgatccaaatgttgtattcttctggggtctcatctacagaaggantattcaaatatgtacaaattctctcaaagaagatttcatgaaaagtgtctgcaataacatctatgggaaggaaaaatgtgcccattcagacatcacaatggccgttgttgggcctccccagctgccaaaaaagtgtctgtgatctctcagtttactcagaaaagctgccacaacatatgatggggaccaactaatgaagcagaactacaatgcagtcagttaggctcagctgtcatattgcgtgcaagcttcgattgtgaatattncaacagtaagaagccgccgcttcgattgtgaatatgacaacagtaagaagccgccgttgaagtcattttcaacatcagatcaggattttttgctgccctttttaaggggcttgttcatgacatggaatgggagattttttttttgtgaagtgnnnnnnaaannnnggaggctcnnnnnnnnnnngnnnnnnnnnnaatagggccannnnngnnnnntattcctgnnatgnnttntnnncnnnnnnnngcannnnnntgnananancnt

SEQ ID NO: 1134 - DNA, 506 bp, Zea mays
ctgctcgctgaggtcgaggagcttccccgaggcgaggaagttggcgccctccaccccactgcgcccgccgtgctgaacgccccgcacgcgccctcggccctgcatcttgacgccagtgacagcgcccttctcgcgccactcgaagagctggcagcagccgggccacgcctcctcctgcgaggccggagtagcggccggcgcgccttactcacgatcacgagccgctggacgacgtccccgtcggcgtgcacacccttgtccgtgaggtgcgcgtgcgcctccaactcctcccgcctgaggtcggagaaggccgtgccctcgcgttagccacaaggagatgggtctgctggatacggcttaacaaagttaagggactagattttgattcctagagtttgtagacctaacttgcagagagagacaagtttaaggcgcgacagtgtatctaactataaaaacttcatttcataccgcgcgtgttagttttctatttgcgaatcgagatc

SEQ ID NO: 1135 - DNA, 419 bp, Zea mays
cgtcagcttgcgccaatggcgactgcacttctctgttacctggtggctcctgctcaggtcttgcctggcctggcaatgtgtcatacgcgttcaacaactactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtagg

SEQ ID NO: 1136 - DNA, 511 bp, Zea mays
  misc_feature (19)..(19): n is a, c, g, or t
  misc_feature (41)..(41): n is a, c, g, or t
  misc_feature (103)..(103): n is a, c, g, or t
  misc_feature (109)..(109): n is a, c, g, or t
  misc_feature (114)..(114): n is a, c, g, or t
  unsure (1)..(511): unsure at all n locations
aattagagatgaccacagntcgacaactatacctgcctgcnttcttagcacagtacattgatctcctttaccgtgtttgaaaaattaggacctgttctctagnttatanagttngatttgtctttctatgcatactaggaaaatcttgtgccagttgatcctgcattatataagcggtatttgctaatctggacccatttatgatgccttgcagcgtgagctaacgaagaagcaaatagagaaattgaaaaaccaaaaggagacacttgagtccctgtgtcgatcactacaggcagaaaggaaacaaggccgctccgccagtattccagacgccccttctagccaagaagacatgccagcgacaagtcaagaatcttagcatatgtgcttgtcaatataccgttggtgtccgttacagcttgccgggacttctgaagcctgagaaatgaatatgttactgatatcttgttttgcttgagtttgcgggagttctggtcccatttaacacata

SEQ ID NO: 1137 - DNA, 967 bp, Zea mays
  misc_feature (59)..(59): n is a, c, g, or t
  misc_feature (298)..(298): n is a, c, g, or t
  misc_feature (315)..(315): n is a, c, g, or t
  misc_feature (450)..(450): n is a, c, g, or t
  misc_feature (452)..(453): n is a, c, g, or t
  misc_feature (583)..(586): n is a, c, g, or t
  misc_feature (709)..(715): n is a, c, g, or t
  misc_feature (717)..(717): n is a, c, g, or t
  misc_feature (733)..(738): n is a, c, g, or t
  misc_feature (747)..(748): n is a, c, g, or t
  misc_feature (763)..(768): n is a, c, g, or t
  misc_feature (788)..(788): n is a, c, g, or t
  misc_feature (794)..(802): n is a, c, g, or t
  misc_feature (808)..(814): n is a, c, g, or t
  misc_feature (817)..(818): n is a, c, g, or t
  misc_feature (826)..(830): n is a, c, g, or t
  misc_feature (832)..(839): n is a, c, g, or t
  misc_feature (844)..(904): n is a, c, g, or t
  misc_feature (907)..(908): n is a, c, g, or t
  misc_feature (910)..(914): n is a, c, g, or t
  misc_feature (921)..(966): n is a, c, g, or t
  unsure (1)..(967): unsure at all n locations
ttatggaggataatgttgttggcatcacaattcagcttgcaaagaaggatttcacgatngtttggttgctactgttcaattcttgcttgtcatattttgtcaatttgaccaatttcttggtgaccaaacatactagcgcactgactctacaggtacaaaatactttctgactcatcaattcaactttgtgtgcatgtagttttacacctagcttttcttgccttttctgttactatatttaagatgggtgggtaacggtactaatatgtaccactacattcagctattctgtaacatntgacctttctaatcctntgtgttttgccgtttctgcggagcttgaaacaccctgctcttgtcttgtactagtgtatggtctgaactttgaagtacataacagtgactttaaacatacacaaatggggaaacgccttttgtggtttgatgttngnnattgaaaaaatattggatacttgatggattaaacgcatgtcagaattgaatataaatgttcttaatctgtttgaagaaagtaacatatttgctttaattcctacgggtttaagaaaagtaaacgtctgtnnnntgctgtcctatgagtaaagctttctactcattttgtattttagatgcataatcatcggattgctttatcttggtttatggaccacttgctttgatagtcttttgtttgttatcttgccttacnnnnnnntntcttgttttaagaatnnnnnntgaaatccnncaattattgacatcnnnnnnccttcaggttctcggaaatncaaagnnnnnnnnngcagtnnnnnnntcnntcatgatnnnnngnnnnnnnntgtcnnnnnnnnnnnnnnnnnnnnnnnnnnnnnnnnnnnnnnnnnnnnnnnnnnnnnnnnnnnnnaannannnnngcaacannnnnnnnnnnnnnnnnnnnnnnnnnnnnnnnnnnnnnnnnnnnnng

SEQ ID NO: 1138 - DNA, 1035 bp, Zea mays
  misc_feature (1)..(19): n is a, c, g, or t
  misc_feature (27)..(27): n is a, c, g, or t
  misc_feature (135)..(135): n is a, c, g, or t
  misc_feature (302)..(302): n is a, c, g, or t
  misc_feature (496)..(496): n is a, c, g, or t
  misc_feature (503)..(503): n is a, c, g, or t
  misc_feature (647)..(647): n is a, c, g, or t
  misc_feature (649)..(653): n is a, c, g, or t
  misc_feature (655)..(655): n is a, c, g, or t
  misc_feature (726)..(726): n is a, c, g, or t
  misc_feature (808)..(808): n is a, c, g, or t
  misc_feature (816)..(816): n is a, c, g, or t
  misc_feature (935)..(935): n is a, c, g, or t
  unsure (1)..(1035): unsure at all n locations
nnnnnnnnnnnnnnnnnnnagcagttntcaaggaggtcatcctcgttggccgcgtggatgcccagagcagcaagcatatcaaacacgtaggagaagtccctttcttccgtattcctaaaagcatgggattccccngtctcaggaagtgatcgacgtgctgtctcatcatcactcaatatagaaagctcgctgccatctctagtgtctgtagtctccctcttcagaagcccaagttgcaatctgagctctgcaatgtatacaataaatcaaacttgcgtaagaatgagaaggaagacaggttngtacagaagaattcgatcacttgccttggagatctgcactgatcttctcaaaatccccagagtaaacatcttctccgtccatggaagattcaagaacagacattggactttgctggtcatctttgttggagttcgctggcgattctaatacatcaggtagaatacaaagggtttcactgacatcccctaggtgntgattantctcctcaggagaatctgatgctatatgaggatcataagtggctgggtaatcatcagcttgatggtattcaatttgctcatgctggattgaaaacagttggtagttattaagcatgacaacgaaagatcaggcaaacccccaantnnnnncnaaagatatatggtaagtgtgcacatgtttaaatcaagagataagtgtttgtcaaaaatggtggtgtgcacntttcatgattccagcacaacacacggtgagtgcaaattaaaatggtagataaaaaataatgaaagtaccttggaaccttaanacacaaanaaaccagagaaaatatcaaactgtttgcacaaaagaaagtgcacacctaattgaagacttgctaaagggaacaataggaaagaataatatgataagcacattagtaccttaggcatcanatcatcgagattaggcacaagaaagcagttatctagtgctgttgtggtcatcttaagcacttgctggtcctgttcagcaggagaaagagactttttatta

SEQ ID NO: 1139 - DNA, 1396 bp, Zea mays
  misc_feature (455)..(459): n is a, c, g, or t
  misc_feature (463)..(467): n is a, c, g, or t
  misc_feature (487)..(489): n is a, c, g, or t
  misc_feature (520)..(521): n is a, c, g, or t
  misc_feature (525)..(525): n is a, c, g, or t
  misc_feature (529)..(530): n is a, c, g, or t
  misc_feature (538)..(548): n is a, c, g, or t
  misc_feature (556)..(556): n is a, c, g, or t
  misc_feature (558)..(559): n is a, c, g, or t
  misc_feature (569)..(569): n is a, c, g, or t
  misc_feature (575)..(575): n is a, c, g, or t
  misc_feature (577)..(577): n is a, c, g, or t
  misc_feature (579)..(579): n is a, c, g, or t
  misc_feature (581)..(583): n is a, c, g, or t
  misc_feature (586)..(586): n is a, c, g, or t
  misc_feature (590)..(594): n is a, c, g, or t
  misc_feature (606)..(607): n is a, c, g, or t
  misc_feature (611)..(613): n is a, c, g, or t
  misc_feature (615)..(619): n is a, c, g, or t
  misc_feature (621)..(645): n is a, c, g, or t
  misc_feature (649)..(661): n is a, c, g, or t
  misc_feature (663)..(684): n is a, c, g, or t
  misc_feature (686)..(696): n is a, c, g, or t
  misc_feature (702)..(704): n is a, c, g, or t
  misc_feature (706)..(709): n is a, c, g, or t
  misc_feature (714)..(716): n is a, c, g, or t
  misc_feature (718)..(727): n is a, c, g, or t
  misc_feature (729)..(729): n is a, c, g, or t
  misc_feature (731)..(734): n is a, c, g, or t
  misc_feature (737)..(746): n is a, c, g, or t
  misc_feature (750)..(752): n is a, c, g, or t
  misc_feature (754)..(754): n is a, c, g, or t
  misc_feature (757)..(765): n is a, c, g, or t
  misc_feature (771)..(772): n is a, c, g, or t
  misc_feature (775)..(779): n is a, c, g, or t
  misc_feature (781)..(787): n is a, c, g, or t
  misc_feature (790)..(798): n is a, c, g, or t
  misc_feature (800)..(801): n is a, c, g, or t
  misc_feature (804)..(811): n is a, c, g, or t
  misc_feature (813)..(820): n is a, c, g, or t
  misc_feature (822)..(822): n is a, c, g, or t
  misc_feature (825)..(826): n is a, c, g, or t
  misc_feature (828)..(829): n is a, c, g, or t
  misc_feature (831)..(831): n is a, c, g, or t
  misc_feature (833)..(834): n is a, c, g, or t
  misc_feature (1062)..(1062): n is a, c, g, or t
  misc_feature (1104)..(1104): n is a, c, g, or t
  misc_feature (1157)..(1157): n is a, c, g, or t
  misc_feature (1181)..(1181): n is a, c, g, or t
  misc_feature (1285)..(1285): n is a, c, g, or t
  misc_feature (1303)..(1310): n is a, c, g, or t
  misc_feature (1379)..(1380): n is a, c, g, or t
  misc_feature (1392)..(1392): n is a, c, g, or t
  misc_feature (1394)..(1394): n is a, c, g, or t
  unsure (1)..(1396): unsure at all n locations
attaagcgggcagttaatgagtacacttgcaacgctcttgttctcaaggcaagtatcaagtcatccatataaattctttcttattgggctagtttgtgttatatatccatgctattggagtggttcaagagtgacaattgacagtaccacatgacatgtaactctggaattaggcatgctttatttgacaacatttggatgcaaacacttattttttattgaagacctactcttccttctcaatgttcattataaatgaagctttgtgtagtatgagttgaggtgtaagtttatttatatagaacatgtgttgtgtttactcagaaacagtaaaacaatttatcatccacatattacttgaatttgctgaaagtgagaaacttgcaattaaactagttggatggaacctctaggcatattgcacatgtattttcattacacccttgctcccctannnnnggannnnntggtgcaggtgcagtggtannngttgtcccaccgagtcagcaggtcacagatnncgtntctnngcatttgnnnnnnnnnnntgactcgntnnatcccttctnctgatngnanannnagnctannnnnctagtctgtatnncctnnntnnnnnannnnnnnnnnnnnnnnnnnnnnnnntatnnnnnnnnnnnnncnnnnnnnnnnnnnnnnnnnnnncnnnnnnnnnnncaggannnannnnactgnnngnnnnnnnnnnantnnnnatnnnnnnnnnntgannntntannnnnnnnncgattnnttnnnnngnnnnnnnagnnnnnnnnncnntgnnnnnnnngnnnnnnnntnccnnanngncnnttagtatgcccttttgtgtttcatgtcatgtttagtttgtccataaggtttttatatatgcaggcaaatcaagtgggcactgtcactgaggccatagaggttgtgaagcaggcaaaggatgctcattggggtgtgatggtgtcacataggtcgggagacactgaagattctttcattgctgacctggctgttggtgcttcagccggacagatcaaagccggtgccccntgccgtggagagtgtctcactaattacaatcaggtttttctntctgttggatcctttacatttctatttctaggtgagtacacagcgtacacacnaccatgaatacagctgacttttgntaatcttgcaatgttgtctttgcagctgcttagaatcgagggagaacttggaagtgaaggcgtctatgcaggggagaattggagaacagtcaacacgagctganctgtggtatcgtttgagnnnnnnnnttgcggggagaattggaaatattgatccgccttcgtatgtagccacttagcttttctttgttttcttgnncaattgcgtgantncg

SEQ ID NO: 1140 - DNA, 747 bp, Zea mays
  misc_feature (1)..(4): n is a, c, g, or t
  misc_feature (10)..(11): n is a, c, g, or t
  misc_feature (14)..(14): n is a, c, g, or t
  misc_feature (17)..(27): n is a, c, g, or t
  misc_feature (31)..(32): n is a, c, g, or t
  misc_feature (91)..(91): n is a, c, g, or t
  misc_feature (126)..(126): n is a, c, g, or t
  misc_feature (209)..(209): n is a, c, g, or t
  misc_feature (245)..(245): n is a, c, g, or t
  misc_feature (255)..(255): n is a, c, g, or t
  misc_feature (272)..(272): n is a, c, g, or t
  misc_feature (283)..(283): n is a, c, g, or t
  misc_feature (298)..(298): n is a, c, g, or t
  misc_feature (303)..(303): n is a, c, g, or t
  misc_feature (330)..(331): n is a, c, g, or t
  misc_feature (333)..(333): n is a, c, g, or t
  misc_feature (414)..(436): n is a, c, g, or t
  misc_feature (561)..(564): n is a, c, g, or t
  misc_feature (581)..(583): n is a, c, g, or t
  misc_feature (585)..(585): n is a, c, g, or t
  misc_feature (618)..(620): n is a, c, g, or t
  misc_feature (622)..(622): n is a, c, g, or t
  misc_feature (628)..(629): n is a, c, g, or t
  misc_feature (631)..(632): n is a, c, g, or t
  misc_feature (634)..(634): n is a, c, g, or t
  misc_feature (657)..(661): n is a, c, g, or t
  misc_feature (670)..(670): n is a, c, g, or t
  misc_feature (675)..(678): n is a, c, g, or t
  misc_feature (681)..(682): n is a, c, g, or t
  misc_feature (692)..(692): n is a, c, g, or t
  misc_feature (695)..(695): n is a, c, g, or t
  misc_feature (703)..(705): n is a, c, g, or t
  misc_feature (707)..(707): n is a, c, g, or t
  misc_feature (713)..(715): n is a, c, g, or t
  misc_feature (717)..(718): n is a, c, g, or t
  misc_feature (720)..(721): n is a, c, g, or t
  misc_feature (734)..(742): n is a, c, g, or t
  unsure (1)..(747): unsure at all n locations
nnnnctctcnnctngtnnnnnnnnnnnaacnngccgacgtgaccaccggaaccacccaccacaccacttgagtcagtgccctcgatcgatnagtgaggaatatcggtctgattgatccctgctggntctcgcatgcccagccggacacctgtagtctgtggagcgcgcgcggtcgaggtcgatctcaacagtgattaggacagagtggntgtgggcttgtagccatggccgttaagctagccgtngcagcaacangcaacctaggtggcagnccgcagacgangacaggatcaaaccnccccncacccccctacgaccgcgacgcgaatnnanacagcagcacgcaccttgcggggcgatgcggccgacgcaaacgtacaccaccaccagtccaccaccatagcaagcaagatnnnnnnnnnnnnnnnnnnnnnnnttcgttctgacctcgccgatcgagctgtcccccgccggcgccgcgcgaggcaggaaggccgcccggccggctggcgcaaccaccggggattgagcgccgatcgttacggcacctaacctaacacnnnncccgcccctagcgattnnngngcgcgaggcaacgtcaacggatcgagtgtactnnngntcgtcnntnngnatctttcgtactccgcagtaccnnnnntggaaaggnactcnnnngtnntggcagcgcnggnttgatcgnnntnggatgnnncnntnngagtgagtgatgnnnnnnnnnaaaaa

SEQ ID NO: 1141 - DNA, 864 bp, Zea mays
atctgatatttccatctgttttttcttttcttcagccaaaaggatagttttgtctacctccatgcataatgtttcagataacttacaagggaactcccatggcaacatttttggcactgtagaatgtactgcatctaaatctagtgagaaaggaccacacaaacattcctttggcctctctgaaagtagaacagcaacatgatcagcagttcagcacttctagagttaaaacagcacggcattgcaaatgaaacaaaaacggaaaagaaaaaatatttcatggtcaactaccaactagttaagcagtacatggaaaataactacaatagctcttctggaagcacaagagtgcacaactgttagtgtggggtgccaacagttcattctgacagatctaacagactaaccccacatcatttactgaaagaatgaagggaagtatctgcaacatgcagataaaactttctatatatgaaattcattttagccaaaaaaaacaagccctagtaaattaagaacctcctaggcctagcttagatttataaggtgactaatgcacatgtcacacatgaatcatgatataattctcaaaactgttgcagggtgatgctctgcgacaaaccccatcaatctactccattccaaaatgtaaggtgttttagttttgtccaaagttaaacttctataatagcaaatagccctatcaagacatttcatgggtggattttattaaactaatttaatgttgcagatgttggtgcagtttttgggcaaacctgggccaaaaaataaaagaaaccaaggtttgactttagggataaaagcttaaaaccttcttacatttcttaaatggggggggggggc

SEQ ID NO: 1142 - DNA, 512 bp, Zea mays
  misc_feature (203)..(203): n is a, c, g, or t
  misc_feature (360)..(361): n is a, c, g, or t
  misc_feature (404)..(404): n is a, c, g, or t
  unsure (1)..(512): unsure at all n locations
gactacagtgtgaacttgatagaaggatcacagaccagaatgtgaaaaaacatagggagttgtacaaaccatttttcaaggccatgtgatttagttgcttcctcaaacttctgccttacataagctccatttctcatgtcagatgtatttacctagaataatgccaaacactaatcagtactagtcatttgcccgtgcattgncacggttcctatatatcatatgagtagactttgttttaataagacacaaaaatatgtgttctattggttagatgagtgtaaatgtggagccaacaaccaaagttcaaaccctcatttgtgcacaattttacttaatttttacattaagcggaaaganngtgacgcgggacaaccgttgaaaccagtgctttatatagtagngaaaatcaagcatatgaagcagtagacttgcacttctcagaaagaaatgctggtgaaattacctctatcacattgaagccttgttctctggcgcatgcaaaaactgca

SEQ ID NO: 1143 - DNA, 1064 bp, Zea mays
  misc_feature (513)..(513): n is a, c, g, or t
  misc_feature (539)..(539): n is a, c, g, or t
  misc_feature (897)..(897): n is a, c, g, or t
  misc_feature (922)..(922): n is a, c, g, or t
  misc_feature (924)..(924): n is a, c, g, or t
  misc_feature (926)..(926): n is a, c, g, or t
  misc_feature (929)..(929): n is a, c, g, or t
  misc_feature (950)..(950): n is a, c, g, or t
  misc_feature (954)..(955): n is a, c, g, or t
  misc_feature (958)..(958): n is a, c, g, or t
  misc_feature (991)..(993): n is a, c, g, or t
  misc_feature (1017)..(1017): n is a, c, g, or t
  unsure (1)..(1064): unsure at all n locations
acaaagtatgtttatggataaggtgcatacatgatcaaaatcaagctttagaatggaagtttagctgacctccagtaaggatggcaatatcatccaagtactgagtcttgcgctctccaaaaccaggggctttgatggcagcgatcttcagtgatcctctgagcttgttgacgacaagggtagcaagagcctcctgctcaatatcctctgcaattatcaggattgggtatgcacctctgatggattcttccaaaacgttgataagatcccttgcattggtgattttcttatcaaccaaaagcagctgaacaatgaagatgaaagacaatagcattaatagtctgaaacaggaaagcaactgctgtttgcctaggaactgtcttacccccacggccccaccccctgataggtcagagtttttttcttttgaaacaggaaagcaataaacagcaaaaaaaatagaattgatatctcagattttacagttaccttgcagttctcgtactctgcagngcaagcataaaccatgacggcggcgnacgcacctgccgccagaccagccggtgttgacgagccaccctgtggcgccgtacttctgcatcttctcggcgagcatggcggcgtacttggtcgggtggagcatgatgaaggccgcgccgaagcaggcggagaaggtggcctgtggctccttgatgccgtcctccgtgccggcgaccagggcggtgtatccgctgatgaagtggtacatggtctgcgccaggtccagcttgctcaccggcgggagcacgccgaaggcgtcgcacgccagcaggatcacgttcttggggtgtggaccgacgcatggtatcttggcgttggggatgtactcgatcgggtaggcagcccgagtgttctctncgatgcaagaatggttttttttttngntntgntgatgcctgtgtgtgactcgnaaannttngagtctgttgtgtacggagaccatgacatttannncttaccggtgacagatttgtcggngtagtcaacttcacgagtatgctcatcgaagacaacgttctccagca

SEQ ID NO: 1144 - DNA, 645 bp, Zea mays
  misc_feature (546)..(546): n is a, c, g, or t
  misc_feature (552)..(556): n is a, c, g, or t
  misc_feature (558)..(559): n is a, c, g, or t
  misc_feature (578)..(580): n is a, c, g, or t
  misc_feature (596)..(601): n is a, c, g, or t
  misc_feature (603)..(606): n is a, c, g, or t
  misc_feature (608)..(608): n is a, c, g, or t
  misc_feature (611)..(613): n is a, c, g, or t
  misc_feature (616)..(623): n is a, c, g, or t
  misc_feature (625)..(625): n is a, c, g, or t
  misc_feature (633)..(633): n is a, c, g, or t
  misc_feature (640)..(642): n is a, c, g, or t
  unsure (1)..(645): unsure at all n locations
aaataaagatcaaagattgtttctacaaaaaaaaaaactaattgtatgtaagtgtaaagatttaccaaccttgaaagtcatcatgttaaacagagagatttttcctccagaagcggacatgacatatgaatcattcttcgacaaagcaaagcagtgaacagcttcttcaggattgttgtcagtcgtgtcattagtcatcaaaatgccacttggtggttgccatagtgtgggagacacactcgcgcttgcctataagattgatgaatagcaaactgaacaatttagtaacaatctaccatacacaattttcaccaatgatatgcagagaagatgagcgatctgaacactatttatgcacatctatatgtacataagaatcggatctcacctttccagaattccgatcactgcgtggccatttccagagtagatgaacagcacttgaagttaaagccaagatagcaagaccagaatttgtgtaaatcaatctcgagatctgcaattataaatttcttcaaacaaccttatgataaaatcagcatagtnaatgcnnnnnannattgagaaataaagatcannngtcatatatgagatgnnnnnnannnnantgnnntgnnnnnnnntnacatatantgaactnnnaaa

SEQ ID NO: 1145 - DNA, 494 bp, Zea mays
  misc_feature (46)..(46): n is a, c, g, or t
  misc_feature (180)..(180): n is a, c, g, or t
  misc_feature (349)..(349): n is a, c, g, or t
  misc_feature (492)..(493): n is a, c, g, or t
  unsure (1)..(494): unsure at all n locations
atgcttgtatgatcggttgaaactatttcctggtttgctttctccntcgatgcggcctcttttacagagcaacaaaagggtcttaaccaacaacccaagtaagtgttgaatataagcacagtatcagttgaatatatgccactagacacgtgttgactggcaattaagtgcaaagtggtncttactgtcagcagttggattagtcgagtttgaaagtaaagattatgttgcgctgcaaatttcagataagcgaaaatctagcacagatctctctgcaactcagccacctctgaagaagatggcaacggacgcaacagccaactccatggcctcagcttccatgggaggnaacatgcaaggtgccatggatggctttcccaaccagttaggcaaccctggcatgatgcaggcctcgtcctctgggcagacggtggagagcatcccatcagctgcggtccggagggatcagggcagtgatctcgcgcagagagnnt

SEQ ID NO: 1146 - DNA, 680 bp, Zea mays
  misc_feature (73)..(73): n is a, c, g, or t
  misc_feature (149)..(153): n is a, c, g, or t
  misc_feature (165)..(165): n is a, c, g, or t
  misc_feature (203)..(203): n is a, c, g, or t
  misc_feature (212)..(221): n is a, c, g, or t
  misc_feature (307)..(309): n is a, c, g, or t
  misc_feature (367)..(367): n is a, c, g, or t
  misc_feature (390)..(390): n is a, c, g, or t
  misc_feature (462)..(462): n is a, c, g, or t
  misc_feature (558)..(558): n is a, c, g, or t
  misc_feature (560)..(562): n is a, c, g, or t
  misc_feature (580)..(581): n is a, c, g, or t
  misc_feature (589)..(592): n is a, c, g, or t
  misc_feature (607)..(607): n is a, c, g, or t
  misc_feature (619)..(620): n is a, c, g, or t
  misc_feature (622)..(624): n is a, c, g, or t
  misc_feature (629)..(634): n is a, c, g, or t
  misc_feature (652)..(656): n is a, c, g, or t
  misc_feature (675)..(676): n is a, c, g, or t
  unsure (1)..(680): unsure at all n locations
ttctacatcaggcggttggacgagcggccaattagctcggcgaccgagaggcggcgcgtgatccaatgcttgnaagcggccatcgagaggcgcgcatccgaggtgcgtgatcgctgagtatctcccttcctttccctacatgccacgcnnnnncacgccaccgcngcaaaaacacacaacgccggatgctcgctccaccttcntccctcccnnnnnnnnnnagcccaggcgcaacgtctctttcacgccctgcccaactttccacttcaccgccatgtgttcggacgaaatcccagccgcaccaccnnntctctatctaggagtattctctaacgccagagcgatcctctgtggctgtgcgcagggngtgaggctggagctgcgcatcancgaccgccgcgggctgctcgcctacgtcacgcgtgtgttcagggagaacagcctctcggtcacgcacgccgngatcaccaccaggggcgacatggccatgaacgtgttccacgtcaccgacgtggccggccgacccgcggaccccaagaccatcgacgaggtgatccngnnnatcggcacggagagcctnngggtggannnngagcggtggccgcgnctgtgctcgacnnannncgacnnnnnncgcggcggcggcggtgcnnnnntcttctcgctcgggagccnngtca

SEQ ID NO: 1147 - DNA, 717 bp, Zea mays
  misc_feature (24)..(24): n is a, c, g, or t
  misc_feature (202)..(202): n is a, c, g, or t
  misc_feature (300)..(300): n is a, c, g, or t
  misc_feature (606)..(607): n is a, c, g, or t
  misc_feature (611)..(611): n is a, c, g, or t
  misc_feature (613)..(613): n is a, c, g, or t
  misc_feature (615)..(617): n is a, c, g, or t
  misc_feature (635)..(636): n is a, c, g, or t
  misc_feature (639)..(640): n is a, c, g, or t
  misc_feature (652)..(652): n is a, c, g, or t
  misc_feature (656)..(664): n is a, c, g, or t
  misc_feature (673)..(674): n is a, c, g, or t
  misc_feature (678)..(679): n is a, c, g, or t
  misc_feature (681)..(682): n is a, c, g, or t
  misc_feature (684)..(716): n is a, c, g, or t
  unsure (1)..(717): unsure at all n locations
cgttcccgcgctgcccccgccgcngccctcgaggagcctggcgaagcagaggagcgcgcgggactctgtaatgctcttgcagacttcgacgtggccgcgcgcaagcatccacagagcctttgccgccatggccttcatctgcgccttggtggccgggtcctcggcctcgcgcgatccgcggccactagaaccgtttgagctnaggctcagctggggtcttgcacccggcggcgtgactccattcgttgtcgtgttggtcgccgccatcgcggattgcaccaccgattgcatctggttcgntcttgcccgctgttggccagtagaagtttccaacgggttcggcggcacattggttgaggaaccaggctcgtcttggcgcacgcttcgcgatttggcaagcacaacggagtgaagattgtcgagcgacgtcgtggtcgccgctgccgcagtaacggcgttccgggagccgttcacgccgatggaatacctgctatgctccttgatggttccggaagagaggtgagtgacgagatgccggacggcgttgctctgcgcgaacaggtcctggcacttgtggctgtggcgcgccagcgacgcgatggcgtnngcgncngnnncctgcacgcgcatcggcnnctnnttgagcgcagcngcgnnnnnnnnncacaccccnnagtnnannannnnnnnnnnnnnnnnnnnnnnnnnnnnnnnnng

SEQ ID NO: 1148 - DNA, 827 bp, Zea mays
  misc_feature (1)..(1): n is a, c, g, or t
  misc_feature (112)..(112): n is a, c, g, or t
  misc_feature (123)..(123): n is a, c, g, or t
  misc_feature (177)..(177): n is a, c, g, or t
  misc_feature (374)..(374): n is a, c, g, or t
  misc_feature (462)..(462): n is a, c, g, or t
  misc_feature (471)..(479): n is a, c, g, or t
  misc_feature (629)..(633): n is a, c, g, or t
  misc_feature (642)..(642): n is a, c, g, or t
  misc_feature (672)..(672): n is a, c, g, or t
  unsure (1)..(827): unsure at all n locations
ngatgcaccgacatcagctcgaacctgctgctactgcactgctcctctattttccttcccggtccataaatccaagcatccagcttctccttcaattgacaaccactagcancagcagctgcngccgccatcaaactagcactcaccttcctttctctctgctccaatccttccaanatgatgtagaggtgtattttctgaggtcaaaaacaaaagagaaagcttacatgtagagatgtattttctgaggtcaagccatcacacttctcctgaagttgtttcaattcttctttaagtgaactattttcctgctttagcaaatctgcacgattggctacttcctcccattcagcctgtagtatgccataaaaaanatagaatacatcaaggcttgcatgaagcaaagaacaccaaattatatgaacagacgtggcagcatctacccttttaaggtgtcacagngaggaaatnnnnnnnnnctgtgggtcctgctatcagctatatgcatgagcttggagacaaatatgcagctgttttcacaatgttcctcaattattttctttagccttaaggaaaactcatgatatattattccttggatgctatctgctttctatgatcctggttcnnnnntcatcttcnaaggaaaaaatgcagatatattagtcctcnactaggtgtattgttctggtgaaatgttggttgtcatccatgaacactaactaaccactacactactacagtagcacatcttcgttctttattctaggaacatgtgcaggaacacatgcatggtccacatggttatgcatatttagcgattattc

SEQ ID NO: 1149 - DNA, 827 bp, Zea mays; identical to SEQ ID NO: 1148
  misc_feature (1)..(1): n is a, c, g, or t
  misc_feature (112)..(112): n is a, c, g, or t
  misc_feature (123)..(123): n is a, c, g, or t
  misc_feature (177)..(177): n is a, c, g, or t
  misc_feature (374)..(374): n is a, c, g, or t
  misc_feature (462)..(462): n is a, c, g, or t
  misc_feature (471)..(479): n is a, c, g, or t
  misc_feature (629)..(633): n is a, c, g, or t
  misc_feature (642)..(642): n is a, c, g, or t
  misc_feature (672)..(672): n is a, c, g, or t
  unsure (1)..(827): unsure at all n locations

SEQ ID NO: 1150 - DNA, 643 bp, Zea mays
  misc_feature (6)..(6): n is a, c, g, or t
  misc_feature (79)..(79): n is a, c, g, or t
  misc_feature (268)..(268): n is a, c, g, or t
  misc_feature (282)..(282): n is a, c, g, or t
  misc_feature (305)..(305): n is a, c, g, or t
  misc_feature (352)..(353): n is a, c, g, or t
  unsure (1)..(643): unsure at all n locations
acgcanggttagcttgttctctgaattcgacgaaaatgctactgtggtttgccattggatggcgtttcatgattccatnaattttcggtttcagaattatcagaagcgacctcaaagctgaagaagccgtcacgagtggctcgcgacatgttcccgacgcttcttgcagagatcgagaagatcgtgccagacaagtgcgatctgttgcaggagtcatacagcagattcaaggtaaattggtaacagtaattttcacacgacttgtgantaaagtaacgtagnatacgtgcaagttggaaagactngcatcatttgtttgacaactttgcctacttcccttacattatatatnnttatcggatcaactgatttgtctgctgacaacttccattgcatgcgcaaaatcagctgttctgttactgtataagctgttacattaggaaaatatatacagattttgcgttgctactcgacgagcaattgcaatcaactttacaattctgaaaaaagagcatgagttgattgtttgggcgtggtaaattgatgtttatgtggagggcttgatcataaattcataataatgctctactcgtactggttaacaacacagcagcagcctaaaacttcctttaacacaattttt

SEQ ID NO: 1151 - DNA, 682 bp, Zea mays
  misc_feature (563)..(564): n is a, c, g, or t
  misc_feature (567)..(567): n is a, c, g, or t
  misc_feature (584)..(585): n is a, c, g, or t
  misc_feature (588)..(588): n is a, c, g, or t
  misc_feature (590)..(599): n is a, c, g, or t
  misc_feature (602)..(606): n is a, c, g, or t
  misc_feature (610)..(646): n is a, c, g, or t
  misc_feature (648)..(653): n is a, c, g, or t
  misc_feature (656)..(656): n is a, c, g, or t
  misc_feature (659)..(666): n is a, c, g, or t
  misc_feature (668)..(673): n is a, c, g, or t
  unsure (1)..(682): unsure at all n locations
gcagagttcatcctgaggacctagctttgaaagttgagtctgcgttctattctgctggtgctcttataatgtcagattcatccgctacagccatgtcatctctgctggctgtgcagaaaggttcagctgcacagctatcccttcccagtacctttggaacagcttctagagcctcccgagctctacgggaaacagtatctgctttgcctgttgagggtcgaatgctttgtgcctctgatgttttaccacttcctgacgctgcttacatgttgcagtctttgtatgctgatgtggaatgcttcacaggtttcagaaaaccttctgagaaggcatgtataaaactttgggcaaaaggagatcttcctacccagcatatcttgcctcggaggagggttgttgtattcaatactatgggtttgatggaggtaatttttaacaggcctgttgatattctaaggaaattgtttgatgggaacaccttgagatcacaaatcgaagaattctttaatcgctttggtgctggagaggctgctgcaatgtgcttaatgatagctgcgaagctnnttnatgctgaagatagtctnntangnnnnnnnnnntcnnnnnaagnnnnnnnnnnnnnnnnnnnnnnnnnnnnnnnnnnnnngnnnnnnatngcnnnnnnnncnnnnnnatctaatac

SEQ ID NO: 1152 - DNA, 702 bp, Zea mays
  misc_feature (404)..(404): n is a, c, g, or t
  misc_feature (408)..(408): n is a, c, g, or t
  misc_feature (423)..(423): n is a, c, g, or t
  misc_feature (428)..(428): n is a, c, g, or t
  misc_feature (487)..(488): n is a, c, g, or t
  misc_feature (535)..(540): n is a, c, g, or t
  misc_feature (553)..(553): n is a, c, g, or t
  misc_feature (558)..(558): n is a, c, g, or t
  misc_feature (611)..(617): n is a, c, g, or t
  misc_feature (637)..(638): n is a, c, g, or t
  misc_feature (643)..(644): n is a, c, g, or t
  misc_feature (646)..(647): n is a, c, g, or t
  misc_feature (650)..(651): n is a, c, g, or t
  misc_feature (655)..(656): n is a, c, g, or t
  misc_feature (658)..(661): n is a, c, g, or t
  misc_feature (673)..(680): n is a, c, g, or t
  misc_feature (682)..(693): n is a, c, g, or t
  misc_feature (695)..(698): n is a, c, g, or t
  misc_feature (700)..(701): n is a, c, g, or t
  unsure (1)..(702): unsure at all n locations
aatccagtctatggtctcagctggaaggacttacagatattctactggaggcatatatgtgccttttaactgcccaatttgaacgtgggcaggaacatggtgtgctagtgcaagaatattgtgaacgaagagatgaacttctcagatccctctacaaccttgctaaacaaatagtggaggccaaataccaggtttggtttaattgaacatcgttattttcctaagaactatcattactgttttaagatgttactttaacttttggaattggtgttatccatttatttgcttattcggttatctcatgtttttttggatctgattagtacttgcctatcattcacttggataatagtaatattaaacttatttaatatgtgcgtagcttatcttagtgataatgngctnttgtactggaataancttcnaacttctaacttgattcacatatctgtaatagtaaatcaggcaccattttggtattcanntagccatccttccatattggacacatgttattgcattttgatgattnnnnnncaactagttctcngattntcgattgatttctacagtagtcattcactctattatttttctctctcgaacannnnnnngagctgtgtatcatttcatnnatagnngnnaannacannannnnagcccacacacnnnnnnnntnnnnnnnnnnnnannnncnna

SEQ ID NO: 1153 - DNA, 353 bp, Zea mays
ttacacaaggaatgtatcctgatctatttgccattttcttgatttgataacattaccgacacagcaaataggtaacactggcttatatgcatacatgttaaattacaagggagtacccgatagaaaatcatcaagcaagggaaccacttacgcaacatctttgacattctgaggtgcatcaaatccatcatacaaagtgcatggaacatcaccagagaaactaaagcatcgttcgtctaagcaagtgtttgtggccggagacgagaatgacatggacctcctgagctgcttcggattggctggttcctccttattccgcttttgaccacggcttctggatcttgacaaccttg

SEQ ID NO: 1154 - DNA, 438 bp, Zea mays
atctgagacacattgttatggtaaaaaatgcacgaattgaggaagattatggcacccatatcgctgatcttgacataaatgagttacaagagcggcgcaagcgaaggattgaagaactccaagtaattgaaaggacacaccatgaatttctcagcatgaaaactaggatggtagctagcattggggagttattgtcaaaaatggaggcactgaaacaaaaccgaagcacatgaactgaggttactattgcagaaatcgaagttactcaacttgtttaaggaagcctgcacatattgttgtaagtttctttttcttttattatgatttccgcttgttctaggactagctttctgtaatattattctttttcactactgctgtgatagagattccttcacttttggatcatttcaatcacataggcagaatgatgagatg

SEQ ID NO: 1155 - DNA, 698 bp, Zea mays
  misc_feature (1)..(1): n is a, c, g, or t
  misc_feature (177)..(177): n is a, c, g, or t
  misc_feature (197)..(197): n is a, c, g, or t
  misc_feature (416)..(416): n is a, c, g, or t
  misc_feature (473)..(473): n is a, c, g, or t
  misc_feature (570)..(570): n is a, c, g, or t
  misc_feature (677)..(679): n is a, c, g, or t
  unsure (1)..(698): unsure at all n locations
ntcagcttttctttgctggcatcattgtcatctgtctggatgaacttctccagaaaggttatggcttgggatctggcatttctctgttcattgctaccaatatctggtaagcatcttggacttaatccttttattgatgtgctgttctgttgcacttaaagcttataataagaattntttcatgtagcgagaatatnatctggaaggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtncttccagtgagatcaaagaatgctcgtggccagcaaggctcatatccaattaagctnttctacacttcaaacatgcccatcattctgcactctgcactgattaccaacctctatttcatatcccaggtacgcacctcatttccaatgctgtagnaagtcatgtcttctgtgtgtatgtgtaaatgctgatgtattttattgctatcacagcttctctacaggaagtacagtggaaacttccttgttaaccttcttgggatnnngaaggagtctgaatactct

SEQ ID NO: 1156 - DNA, 1349 bp, Zea mays
  misc_feature (116)..(116): n is a, c, g, or t
  misc_feature (647)..(652): n is a, c, g, or t
  unsure (1)..(1349): unsure at all n locations
actacttactgaaagtgggcagcttttcaagcctcgacctcagtttctgcaagtcacccaacaagagagagaacctgttacgattattttccttttgtacaaaaagaatttccacnggatccaaaagtataccaccccctcccgaccttcgtcctcccaaccttaaacatgtgcctcggggcaaatgccaatgcgacatccgcttcagcagctaaaaatggcatagctgatgtgctgtgctccttccaaaattcagtgttgtgacttggtgatttgtccctcagccttgctgtcctgtcctaggatgatgcactgtcatcgtcagagttgttctcccttcgttgtccatacacacttagaactggcattgaggtggctgaaatcctgaaagacctggctgacccaataaccgttctgtcctgctgtaacctgccaacctccttgcagacatgatccaacgtcgagaggaagtccctcaccaccatgaatatcctaagagggtgcgcttcctctttcgcggtgtcaccatggaagtactcggtgatgtcttttactctcaccagggccttcttctcctcccctctgactttgtctatctccgtctcggctttcttcagaaaactctgcattgtcgtaaagaacttttnnnnnngagtgcattgcctctcgagctgcaagaccgacttgatcttttcaatgcctgtttctagcttactaacatagccatgcaacacatcaaagtccatcatggctgctttcttgacatttcccagctcactgctgaggccagagacaagtttcagaccttgcttccgcaactgctcgtctttagagctatgaataatcatggcgctttctttttctgattttgcatcttctgatcgaattatttcttggacgacgaaatgcaacagcgttgttttaccatcagtgctcttgacatcagcaagtttcaggagagtgtcaagcttgaaagcttttgcctcaccccggtttgtgccgacattcatccggttcccggttctcagcaccgcctcgagtagtttcaggaacaacctgctgcctctgagatcttcgcaggctgcctgaaaacaagtgaagaaatgttaggcacctataagtctaaatctgcggtgtggattgatacacaggtcagtgataatgttagtaatcaaaatgatggaagtgaaagaaggattaatgcagcatggattaccattttagcgtacctctaatgtctcaaaagatttcattaagtaatttatttcggcctcaaaattggctcggtatagcatggcatcaactctcttgaaggcaaaaggtatatcaagcacagctttgagaaagcg

SEQ ID NO: 1157 - DNA, 645 bp, Zea mays
  misc_feature (31)..(31): n is a, c, g, or t
  misc_feature (220)..(220): n is a, c, g, or t
  misc_feature (245)..(245): n is a, c, g, or t
  misc_feature (289)..(289): n is a, c, g, or t
  misc_feature (328)..(328): n is a, c, g, or t
  misc_feature (640)..(640): n is a, c, g, or t
  unsure (1)..(645): unsure at all n locations
cttgacgctatcgcgcgcggcggcctcgctnatccggaggcactccagctcctgcttcgtgcacttcacggcggtgtccttgtcgccgagcacgctcttgagcagggcgttctcgctccttgcctcctccagcgcctccttcgccacattggtgtccttcaccgcctgcttcaggatgtcccgtagcttggcgacctcggcccgccaggagcgctgcgantccaggagccgcgcgttctcgtgcngcgcctcggcgagctcggcctccgttgacttcatgcacgccgtnaacccgtcctccttgccccgccacgcggtgaaggactcntcggcttcggcccggagccgcgccacctcgtcggacagggcgcggagcttctcgtccttgcgtttcgccgacatgtgcaggcggtcggcgtccagcctggccgactccgcctcgtgctgcgcgcgcgccagctgctgcttcgtcgtgtgcagctccgcgttcacctccttgagcgctatcacgaactcctccatcgccttcttgctcttctcctccgccgccagcgccacccgcagctcgccgtgaaccctctgcatgtcgcggtcgcgccggtttctcgccggcatcgtggcgacggggcttctggcggcntcgag

SEQ ID NO: 1158 - DNA, 417 bp, Zea mays
  misc_feature (330)..(333): n is a, c, g, or t
  unsure (1)..(417): unsure at all n locations
atgcggacactggacacacacagacacaccgatcaatctcccatcgcgcgcgagcagtactgtttcacggtcaatggaatctctagcggcacagcacagcagcacactcatgctgtccgtgtactctagtagcacctcgactgcgccattttttgtccgcagaacaattttttttagttcccactgacgtacacgtacgtgtgtgctacagttgactgaaacattcattccatcgatctgaacctgataagggaacagaacgaggtgacgacggccgcggtactgaagctaacgcatttccagagatgagctagtggtatagtaccagcnnnnaactgatgatacagcagatcgacacgccatacatagatcaccgagcacgtactcattcttctgtctggcgtatgcagactgcac

SEQ ID NO: 1159 - DNA, 932 bp, Zea mays
  misc_feature (131)..(131): n is a, c, g, or t
  unsure (1)..(932): unsure at all n locations
tgccttttcttttgactgtcaaacccatttgcatcttggtgcttttatcaagtggtattgtatttgtatctctattttgtggtttgatgatttctcttttaccttttgaacatagtgcatagtaacatttntttgttcatacacatgaaatgtttcttgtttgttacgtaacaccattttttttgttttaccatactctgtagatgcttatggacgtcatattccattattctagtattccacaaatatttgtctgattttgttctcacatgttatgaatcatatgcaggccttggagaaagctgttgcagatgcatttccaaatgcatcaaagaaaatacagagcatcatcaagaatgtgagtaatcaaacaattttttttaccatgtcctctcccaattaggattttttaaggaataaggagtaaacacacttcacatttggatgttctttcagattgcaaattaccaaggacctgagaggtatgttctgaaatcagggttggaggtagaaagctcaaaaagtcatgtatctgaaggagtaaggtattattgttttcttgtttaagtccaagctctggtccttctctcttttggatctcgcagaagttggttttcattatgttgcttctgcaactttggacaattatatgcctacatatttgtaattctaccataacgctttaacaaacatctattgctgtgtctaacagatccatcagtaagaaaattgaggaatcggctccaagcctgacgattgatgatcctgatatatgtgagaggattgacattgtgggctccctagttgctccaactgatggaaaactcagtaatgacagtgaaggtaaggctggaacttccagtgacagtggaagcgatagcgatagtgacagcagtaacagtggaagtgatagtgggagccaaagcagaagt

SEQ ID NO: 1160 - DNA, 724 bp, Zea mays
  misc_feature (142)..(181): n is a, c, g, or t
  misc_feature (360)..(360): n is a, c, g, or t
  misc_feature (385)..(386): n is a, c, g, or t
  misc_feature (695)..(695): n is a, c, g, or t
  unsure (1)..(724): unsure at all n locations
ggagctgctatctatctatcgtcttttgcattatactttcaccgacgaataataagcttttggccatgggagctgcaatttatctagctaggctctatcctattcaaacaaaccctgtatatatacgcgtatatatcctttnnnnnnnnnnnnnnnnnnnnnnnnnnnnnnnnnnnnnnnngctcaaacaaagagtcttattcatgcacttcgggtggtcaactttgtatgtaggtactaggtagatagggctactactacgtactctatccattctagatgataattaagtcgttttttttcttaatacacatggttttgcacttttgctatatatccacgtagaatatgttatgtcgncgtcgtctttctctctctctctctnnatatatgctatccatgaagaatatatgtccataatatagatatctaaatatatgctatgcctagaatatgctgtccacgcgtagaatacgcagcacgcagacgcagtggaccatgcatgcacaaaagacctacgctttgtctagtgacgccgcgagcagatcagccagccaagccaaaggaacctcaagcgcatgcattcgcacgccatccgggggcggcgcggcgcctctgctctgcctctgcgtggccgaaactgtagtggaatcgatcgccaggtgcacccggccgggcgatctggacgcagtggnggcagatggataagggaggcagcaggcac

SEQ ID NO: 1161 - DNA, 750 bp, Zea mays
  misc_feature (153)..(153): n is a, c, g, or t
  misc_feature (237)..(237): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (309)..(309): n is a, c, g, or t
  misc_feature (320)..(320): n is a, c, g, or t
  misc_feature (541)..(541): n is a, c, g, or t
  misc_feature (651)..(651): n is a, c, g, or t
  misc_feature (669)..(669): n is a, c, g, or t
  misc_feature (672)..(672): n is a, c, g, or t
  misc_feature (676)..(677): n is a, c, g, or t
  misc_feature (683)..(683): n is a, c, g, or t
  misc_feature (692)..(692): n is a, c, g, or t
  misc_feature (700)..(701): n is a, c, g, or t
  misc_feature (706)..(711): n is a, c, g, or t
  misc_feature (748)..(748): n is a, c, g, or t
  unsure (1)..(750): unsure at all n locations
tcaaccctgtgcaaggtgcaggtcatgatccaaagattgccaacggtaatagttctgctcacccaggcttaaattccggtgtccagtcgtcaggttccccacctaggcgaacgctggcaaacccaaagcaccctgatctggccttgcagctangaggtagccattcacatagtttgccttagtactgtgatctgtgacagaggcatgagttcaacactgcttcgtccggtaccttgncaagcggagcacgagaccgatcgaagaggtaagaagtgtttggtttgtcgtcagagngnggnggtggcggcngcgggacatcntgtagggtccctcgatttaattgatcatttgaccccctgtgagttgtttgtaaaagggtagggtagcttctgtacaggttctaatcttactggagatgataatgcttcggatgaaggcagcgcccgctgtccagcttgtaacattattgatagtagaaagaagaggagggaagcatacaggcgaaaaggcagtgaataatttgtgcctttttgttttgccncccgaccctgagtggacgcactccgtttccaaatgtacgagtggctaacctcggtcagcttttcttgagcattcgttcgttcatgttgctgtcgtttgttatgtttcttntgcttgttaggctcactnctngcgnnctggcntctgtaggncatgtganngcgcnnnnnngcaatgtctgcatggacacatcgctgtgatcttgttnca

SEQ ID NO: 1162 - DNA, 685 bp, Zea mays
  misc_feature (274)..(274): n is a, c, g, or t
  misc_feature (306)..(308): n is a, c, g, or t
  misc_feature (328)..(331): n is a, c, g, or t
  misc_feature (348)..(351): n is a, c, g, or t
  misc_feature (353)..(357): n is a, c, g, or t
  misc_feature (359)..(360): n is a, c, g, or t
  misc_feature (364)..(368): n is a, c, g, or t
  misc_feature (371)..(380): n is a, c, g, or t
  misc_feature (385)..(408): n is a, c, g, or t
  misc_feature (410)..(415): n is a, c, g, or t
  misc_feature (433)..(437): n is a, c, g, or t
  misc_feature (448)..(454): n is a, c, g, or t
  misc_feature (489)..(489): n is a, c, g, or t
  misc_feature (495)..(505): n is a, c, g, or t
  misc_feature (512)..(512): n is a, c, g, or t
  misc_feature (514)..(514): n is a, c, g, or t
  misc_feature (531)..(533): n is a, c, g, or t
  misc_feature (607)..(633): n is a, c, g, or t
  misc_feature (642)..(644): n is a, c, g, or t
  misc_feature (658)..(669): n is a, c, g, or t
  unsure (1)..(685): unsure at all n locations
tgcagcactttgtgagagtgaggcacctgtagcagatgaggacgcagagcttgatgaaactcagtctagagctgctctccccacaccgcaacatgctgaagctgatcatacggaagcagctgtggatgagaataaacatacaggagcagggaaggttactgctactgcaacggacgacgatgcagtagaaaagagtcatggagacccaagaacctcagagacctgcaatcctgctggacctacagacaaagcggagaaacctggaaggtactcngaacaaggcgctgatgatgtgactgaagatcnnncagaaaaagaagcccaagcnnnngggaccagcgacactgnnnncnnnnntnnaccnnnnnctnnnnnnnnnnagttnnnnnnnnnnnnnnnnnnnnnnnngnnnnnncattccttacatgggcgnnnnntcgggaacagnnnnnnncatgctggatatgctccgtatgatctctacttgcngaaatnnnnnnnnnnnttctgcntntgcgactgcatgaactnnnatacgagctttgcctatgtgccagtatttcacagaaacttcagacttgtagttttggcttttgagcctttggannnnnnnnnnnnnnnnnnnnnnnnnnncattagttnnncgaaatatttggannnnnnnnnnnncagtagatatcggatg

SEQ ID NO: 1163 - DNA, 604 bp, Zea mays
  misc_feature (3)..(8): n is a, c, g, or t
  misc_feature (523)..(527): n is a, c, g, or t
  misc_feature (534)..(539): n is a, c, g, or t
  misc_feature (546)..(546): n is a, c, g, or t
  misc_feature (548)..(551): n is a, c, g, or t
  misc_feature (553)..(553): n is a, c, g, or t
  misc_feature (555)..(559): n is a, c, g, or t
  misc_feature (571)..(572): n is a, c, g, or t
  misc_feature (576)..(598): n is a, c, g, or t
  unsure (1)..(604): unsure at all n locations
ggnnnnnntagtttctcaagatgctcaagttctcatttgcgcatagtgaccattttgatcagttgttatgtagctgcaaaagatttcagttcccctcagctgttgtccttgcttagtttcctgttttctgtaaacttcagatgcatgcttacacttagaaatccgtacctatctatgataatctatattctcatatccaatattccaatttactcagcaatcatcattccaatctagatgacatgaatgttacttcttatcctggtcttgctagccttattctgtacaacatcatatttttatcaaatttcttgtataataagttgtgcattttatcgttttttctatgaactatgggtatgctggtataatatgggttgtttatgcgtttatgtgagatttaccagctccgccactgcgatacatattaacttcatggtcttgcaaaaattatcaggtgcacatgtgtacacccatgtcctgtactcggtttaccctggattggacggggttctttagtgcnnnnntattatnnnnnntttctgnannnncnannnnnatgaaactgtcnnaccnnnnnnnnnnnnnnnnnnnnnnnagtaca

SEQ ID NO: 1164 - DNA, 611 bp, Zea mays
  misc_feature (188)..(188): n is a, c, g, or t
  misc_feature (243)..(243): n is a, c, g, or t
  misc_feature (266)..(273): n is a, c, g, or t
  unsure (1)..(611): unsure at all n locations
ccgtcggttggtcggagaaccggaactcgctgccaaacccacgggactgctggagtgtctgggcgaaggcctggtacttgcggatgtcggcatcactgacactgcggcgggcgtacttcatggactcctcgaagtgggcagccatgatctcggcaatgtcgtccacctcgtcttcctccatggcctcngggttgtccttcctgcgcctctcccgctcgatgtcctgaaaccaaatgcctcggngttagcaaaacaactctgcatannnnnnnnctgcaaaccgattccgagcaaagggattattaccttctcgatgttctccctgatggcatacttgcacgcacgctggcagatctcggtgatatctgctccactgaaaccctgggtgtacttggcaagagcatgcaagtcaacgtccttagccacaggagacttcctgaggcaggctttgaagatctgaagcctggactgctcatcgggcagaggaatgtagataagctgatcgaggcgtcctggcctcagcaaggcagggtcaatgatatctggtctgttagtcgcaccgataatgaaaaccgtcttcttggcattcatgccatccatctcagtaagca

SEQ ID NO: 1165 - DNA, 329 bp, Zea mays
  misc_feature (6)..(6): n is a, c, g, or t
  misc_feature (43)..(43): n is a, c, g, or t
  misc_feature (48)..(48): n is a, c, g, or t
  misc_feature (63)..(63): n is a, c, g, or t
  misc_feature (76)..(84): n is a, c, g, or t
  misc_feature (111)..(113): n is a, c, g, or t
  misc_feature (121)..(121): n is a, c, g, or t
  misc_feature (166)..(166): n is a, c, g, or t
  misc_feature (169)..(171): n is a, c, g, or t
  misc_feature (173)..(173): n is a, c, g, or t
  misc_feature (230)..(230): n is a, c, g, or t
  unsure (1)..(329): unsure at all n locations
ctgcanggcagtctaaatgcaattaataatgacgcagacgatngatcnatcggtggagacganggccacgacgacnnnnnnnnncaacagcagcggcggtgagcagacgcnnncattcccngccggcgccaaccgcaaggttggtagaggcaaccgaagaaccaangcnnngncccccagacgccaccaaaagtatctcctagaaaccaacgcctaattattcaaattanccagatggtcggacgacgagaaaaaggaggagggataggtcaagaagggatcggacgtgattatttaaggcttgttcgcttatggtggaacaatataat

SEQ ID NO: 1166 - DNA, 618 bp, Zea mays
  misc_feature (100)..(100): n is a, c, g, or t
  misc_feature (118)..(118): n is a, c, g, or t
  misc_feature (126)..(126): n is a, c, g, or t
  misc_feature (280)..(280): n is a, c, g, or t
  misc_feature (384)..(384): n is a, c, g, or t
  misc_feature (398)..(398): n is a, c, g, or t
  misc_feature (562)..(562): n is a, c, g, or t
  misc_feature (574)..(597): n is a, c, g, or t
  misc_feature (599)..(600): n is a, c, g, or t
  misc_feature (602)..(608): n is a, c, g, or t
  misc_feature (616)..(616): n is a, c, g, or t
  unsure (1)..(618): unsure at all n locations
tcttattccatgtgctacatgacatgtatcccctccattttcgtgtctcatggattggtttcattttttacaggtccccgccatttcagacaggctcttnctttccatagtctccgtngacaatgnaaaaacaattgcaaagtccactaaagtagcttctcgtagtggaatatgccagtggcccgacaccatcttggaacccatatggttctccaaggaccaagtctccaaagaatttcaagagtgccagtacaggattattgtttccctggtatgtacnatgatgcatattttcctaccttacctgttcttggatgtctagttcctgcttcaatctcgatgcctattaccttaggctatttactctgtcttattcctgtcgcntggctatgcaattnttgggtcactaacaactgctctcatgtaatgttccagggatcggcaaaatctggcattcttggggagattcttctaaatctctctaattttctgaatttggccgatccaaccgctatctctttgccactgaagagatgcaactctggaacagttttgcaggtgngtttcgctacannnnnnnnnnnnnnnnnnnnnnnngnncnnnnnnnacatgatntg

SEQ ID NO: 1167 - DNA, 464 bp, Zea mays
ttgcacctgtttgatccagcagatacagctacagaaacaatcgatgaggatataactgctgagacattcagtgtcgagaaactggcaaagttaaaaacaatgtctgaaaaggttgtcatgatgcgtagccatgagtcttctgaaaaggatgaacgagcatttgagatcaatccaaatatgactgatgacagtggaactgtgattagaagggcttctgattctatccgcattgatcctgggctaaatgaagctgcatacctatcctgggtcaagaagttcaaagaggcttccatttctagtgaagatgccacagttggatttggaaggcaaagagcagcgcctgaagaaaagctcctgaaacatgatgttaacaagcaaaaaatagaagaaaagagattggccaaatgggaaagtttgggttaccagacactagcagttaaggaacctgatatcacagcaagcca

SEQ ID NO: 1168 - DNA, 779 bp, Zea mays
atgtcctcacaaagcttgccaaagtcaaatggcttgaaattgattgaaccatccacccaacgcaagaggtttccgacagatccctctagatagttttcgtggctgccactgctcttgtcatcatcaccatcatcatgggcttcctcatcgtcgcctgggaggttcaagtcgaatgggatgcttgatgttctatgcagtcgctttgaagtgcttgccgattcttctgtcttttcttgcccatcagagatgtggagcttccgcttactggaataacttgaggcttcactgcttcccaaggaatgccttgacgaaactacaacgttgcctccaccgatgttggttgtgcccggctcaactatgatcttcagttgatgcccacgagctgccacagccttttcttctgaaaaagcattgccctcttccaccccaagagaagcatcctggcatccttggatcattcttgtagacaacaccacaatcgagtcattaagatcagtcactcgtcccccatgcaagtccttgtacctaccagtctccattgcatgaatcaggctctcctgaacaaggcaatcggctttgtcaatattgtcaaggaagataaccgatcgccgcttctttctcagctcttcaaagatacagtcggtggcacgctttcctctgaaactagggttaccccaatcattgaggcttaagtccagatatatcaagttccctgagctaccatgcctttagctcagccaagtgccacaccaactcttcgcttggcaatgctgtcaagg

SEQ ID NO: 1169 - DNA, 1478 bp, Zea mays
  misc_feature (1)..(10): n is a, c, g, or t
  misc_feature (28)..(28): n is a, c, g, or t
  misc_feature (103)..(103): n is a, c, g, or t
  misc_feature (105)..(105): n is a, c, g, or t
  misc_feature (111)..(111): n is a, c, g, or t
  misc_feature (136)..(136): n is a, c, g, or t
  misc_feature (143)..(143): n is a, c, g, or t
  misc_feature (165)..(165): n is a, c, g, or t
  misc_feature (175)..(176): n is a, c, g, or t
  misc_feature (209)..(209): n is a, c, g, or t
  misc_feature (308)..(308): n is a, c, g, or t
  misc_feature (326)..(326): n is a, c, g, or t
  misc_feature (381)..(382): n is a, c, g, or t
  misc_feature (458)..(458): n is a, c, g, or t
  misc_feature (462)..(462): n is a, c, g, or t
  misc_feature (566)..(567): n is a, c, g, or t
  misc_feature (688)..(716): n is a, c, g, or t
  misc_feature (829)..(829): n is a, c, g, or t
  misc_feature (864)..(892): n is a, c, g, or t
  misc_feature (920)..(920): n is a, c, g, or t
  misc_feature (966)..(966): n is a, c, g, or t
  misc_feature (1119)..(1119): n is a, c, g, or t
  misc_feature (1141)..(1141): n is a, c, g, or t
  misc_feature (1173)..(1202): n is a, c, g, or t
  misc_feature (1210)..(1210): n is a, c, g, or t
  misc_feature (1284)..(1284): n is a, c, g, or t
  misc_feature (1419)..(1419): n is a, c, g, or t
  misc_feature (1442)..(1442): n is a, c, g, or t
  misc_feature (1468)..(1469): n is a, c, g, or t
  unsure (1)..(1478): unsure at all n locations
nnnnnnnnnnaaggatgtaagcagcaantctcgaaagtgtgattttatgtgtccttgtgtaactgttgcttcgagtttgatgtatccacttcctttcagaatntnaccttnaacagcatgagaattctgggtccgnactatantttgctgtagaagttccagccntgtccttagnnccatgctaggacttactttcgtgaactgatttncaggttatcaaaaaatggggtgctccaaataagattgacttcctctctctgtcttacacaagacatgcagaagatgtgcggcaggtaagcaattaatgncattatggatgcattttnacttattttgtttgttctctataattgttgtgcttctaaacaatacaaacatttnngttaatgagaaggttgcttagctatatttgaatacagtgtctccactttgtgggagaagaatggtgttaacagtgntagngtttttgtcccctgcaacacaggcacgtgagttcctctcgaaattgggtgatcttagccaaactcagatctttgccaaaattgagaatgttgaggtattttcgnnttggtttctttctttttcattgttagcttatgtatctctgacatctacccacttattgctttgcagggcttgaaccattttgatgaaatactggcagaggcagatggtatcattctgtcannnnnnnnnnnnnnnnnnnnnnnnnnnnntgagaaggtttgctttctcaactaacattgtatcagttcagaagacctcaatttagacatacactagtacccaaaaaaacctaagctgttaaaggaaataaatacaatatagnatgtacatcagcatttactgacataaccttaaacnnnnnnnnnnnnnnnnnnnnnnnnnnnnngttttaagatgcaacaattgtccttttntataccagttcatttagcctttgatctttacctctctaggttctcnatattgtaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttganggtaagttcttgacaatctttngtggactctggcttttgtagcctaacatactnnnnnnnnnnnnnnnnnnnnnnnnnnnnnnaatcatgntgcacaattttatttttacttcagggagtgacgccattctccttggtgctgagactctccgtggtttatatccngtggagactatttcaacagtgggcagaatttgtgctgaggtaaaatttctattgagttttatgttttcttgatgaaggatttatctttacttctgtgtgtactttcttttgcttttcatctggcttttcattgancagttcattatacaatgtttgtnaattgttttacaggcagagaaggtannaaccaagat

SEQ ID NO: 1170 - DNA, 1091 bp, Zea mays
  misc_feature (1)..(4): n is a, c, g, or t
  misc_feature (8)..(11): n is a, c, g, or t
  misc_feature (24)..(24): n is a, c, g, or t
  misc_feature (43)..(43): n is a, c, g, or t
  misc_feature (47)..(47): n is a, c, g, or t
  misc_feature (129)..(129): n is a, c, g, or t
  misc_feature (170)..(170): n is a, c, g, or t
  misc_feature (180)..(180): n is a, c, g, or t
  misc_feature (198)..(198): n is a, c, g, or t
  misc_feature (233)..(233): n is a, c, g, or t
  misc_feature (387)..(387): n is a, c, g, or t
  misc_feature (396)..(403): n is a, c, g, or t
  misc_feature (406)..(408): n is a, c, g, or t
  misc_feature (411)..(415): n is a, c, g, or t
  misc_feature (421)..(423): n is a, c, g, or t
  misc_feature (442)..(445): n is a, c, g, or t
  misc_feature (455)..(456): n is a, c, g, or t
  misc_feature (458)..(458): n is a, c, g, or t
  misc_feature (491)..(491): n is a, c, g, or t
  misc_feature (515)..(515): n is a, c, g, or t
  misc_feature (536)..(536): n is a, c, g, or t
  misc_feature (660)..(660): n is a, c, g, or t
  misc_feature (677)..(677): n is a, c, g, or t
  unsure (1)..(1091): unsure at all n locations
nnnntgcnnnnttaactgttacancgcagtttagtcgagcaantttngaactacaccataattggaactgtaaaagcaaatcctatgatggcaccataggaaaaactgctcagttttcaagcgctatanggattatacatagccaataagtttcggcctaggcaaaaaanttggcaaaancgtgccctagtagacaanagcatagcctgattgtctaatcatccagctcaatnatcttcaccacagaggaatcacccactttctggcaaacgacgacgcggtcgtgggacttgatcacgcccgaggctttgccatggtcaagagcaaccttcaacacagactcatttgtagcactggtagattcagcctgaaagatacaatggagantgattaatnnnnnnnnacnnnatnnnnntcgttnnntcagtcaggtatcaatcannnngtttgccccnncnaatttgaaatatatgaaaactatttaagaacgntaatacgtgacaagttagaggtancaacaattgagtttcaatctnagcatacaccagcttgcttgggactaaaggctcgataaaccatacttatcataccatgcaaactgtttgaaactaaactactgaactgcattctagtgttcttgccttgaaacatggtgtgaancccaatggaagcaaganccattaaacatgatatagttatgttaataaaggttgatatatacatgtacgaaccctagtttcatactactaactaaaaatcgtcaaactgtcttgagacatcttattaccatagaagagttgaaacaacgctagacttcaaagaatacaatgatgctaatcccatatattggctacacgtaggaaatcagaagtttgtgttgcaattatagtatatacttaaatccctctaataaatgagatgtttaacttactgggtgtcgtggatcagcaagcatagggaagaggcctctaactatgagtgattgtcttgcctgcaagaaatcatacaaaaaaatgagtcatatagtaccaaatattagcacaatccactgacaaacagaaaaggaagttgaatggttatatgtttaatgt

SEQ ID NO: 1171 - DNA, 525 bp, Zea mays
  misc_feature (16)..(16): n is a, c, g, or t
  misc_feature (90)..(90): n is a, c, g, or t
  misc_feature (185)..(185): n is a, c, g, or t
  misc_feature (240)..(240): n is a, c, g, or t
  misc_feature (392)..(392): n is a, c, g, or t
  misc_feature (516)..(516): n is a, c, g, or t
  unsure (1)..(525): unsure at all n locations
ctcctgctgggtttancgtacagagcacgagtgaagattttcatgcacagttcatccggctcacactcctccaagatcttatgaatcgtnctgagcttatcgccgtcttcgtccttctggtaccttgcaagctggagcacggtactatagtagcggccggcgagggaatactcgataggctcccnctgtgggtaacagtattccttagcccactgggcgctcctcgtggtagtgacgatnattgcatcggtgccacaggctagcagactcaaggcgtttctggtctcggtccatgtggatccgtccatcttctcattgactatgaggatgatcagggggcagacatagttcaagtgttccttgatcttggtcgctagcgcgtagctcttcanccgctctttcagcttctgcttgatcttggccatcttctgatcaactgtagtctcgaaaacagctttttccgttcggaccaagttcacttgttggtacttgcatgattcccttactgtagtcagncgccgttcg

SEQ ID NO: 1172 - DNA, 670 bp, Zea mays
  misc_feature (56)..(56): n is a, c, g, or t
  misc_feature (93)..(93): n is a, c, g, or t
  misc_feature (150)..(150): n is a, c, g, or t
  misc_feature (608)..(612): n is a, c, g, or t
  misc_feature (623)..(625): n is a, c, g, or t
  misc_feature (628)..(635): n is a, c, g, or t
  misc_feature (644)..(661): n is a, c, g, or t
  unsure (1)..(670): unsure at all n locations
gtatatgttctgctactgctatactctcttcataaatgttggctttactgctttangaactccattttcccttgtgctttattcttgcacacnctgctattcaatttattgatgattgcttttaacgtgtattcttggtaaaattctcancccagacatctgatgaggcaatcccagtcccagttgtccagatagatcaagactcagaccgtgatgcaaccattgtgcagctaagttttggagatcgtttgggggcattacttgacacggtatatattttacattcaccactgatgctttgtctttacattgtggctgctcaaaactgtgttgttttacattttcgtcatatctgccaattattttgcctggtattcactgtttgcagatgaaagctctcaaggaccttggccttgatgtctcaaaaggaagtgtggcaactgactcagctgtcacacaaacaaagttccacatcatgcgattgtgggtgcttgccccttactgttttattttcatgtgtagcatctagttatgtgtgtctatgtggaaaactaaagagagtattcgctattcttgaacatatgcatttaaattcacttttaatgctnnnnnacatagtctcnnnccnnnnnnnncatttacgnnnnnnnnnnnnnnnnnntcatgtgat

SEQ ID NO: 1173 - DNA, 770 bp, Zea mays
  misc_feature (51)..(51): n is a, c, g, or t
  misc_feature (63)..(63): n is a, c, g, or t
  misc_feature (349)..(349): n is a, c, g, or t
  misc_feature (438)..(438): n is a, c, g, or t
  misc_feature (683)..(684): n is a, c, g, or t
  misc_feature (699)..(700): n is a, c, g, or t
  misc_feature (704)..(705): n is a, c, g, or t
  misc_feature (714)..(722): n is a, c, g, or t
  misc_feature (732)..(733): n is a, c, g, or t
  misc_feature (747)..(767): n is a, c, g, or t
  misc_feature (769)..(769): n is a, c, g, or t
  unsure (1)..(770): unsure at all n locations
tgcctgcagttgcacatcacaattttacaactatgcaagcctataagaaangaccgacacaangaaatttgactcgagaaattacctttgcagctatacttgctccactaacaacagggtaaaggctatcagcttttttggcaaccacaaatttgacccctggaaacttttctgtcagcttggttctgtacttttcaggatctcccactgtatctacatatacctttttaaggaggaacatagttactaaacaaatgtggtgaataaccttataaggacagccaaacaagaaatccttttgaactcaagaatatatgctcttacttctgccagtagaactcccatgtcnagaacttttctaacaagacccatggcagagttatgtgatatttcattcagattaactttcgacctgaaacaatggaactgtcaattganataacaagaccaagttcaaatttcaataagtaaaaaggacagacatacctttttaacattttagcagatagatcctttgggcatatgacatccacttcccacccaatagagctattggcctttaaactttcaaatagctcctctctttgttcttccttcaacgtctttgaatctgttcgagaagacaagatcaataggctatgctatttgtctatgtgttagtagcaaaattactcttgaactcnnctgtagcccgaaacnntgtnnaaccgactnnnnnnnnngaacatcacnngatagtaagcatannnnnnnnnnnnnnnnnnnnnant

SEQ ID NO: 1174 - DNA, 667 bp, Zea mays
  misc_feature (151)..(151): n is a, c, g, or t
  misc_feature (242)..(242): n is a, c, g, or t
  misc_feature (244)..(244): n is a, c, g, or t
  misc_feature (405)..(405): n is a, c, g, or t
  misc_feature (558)..(559): n is a, c, g, or t
  misc_feature (567)..(570): n is a, c, g, or t
  misc_feature (585)..(586): n is a, c, g, or t
  misc_feature (589)..(591): n is a, c, g, or t
  misc_feature (593)..(597): n is a, c, g, or t
  misc_feature (603)..(605): n is a, c, g, or t
  misc_feature (607)..(612): n is a, c, g, or t
  misc_feature (616)..(639): n is a, c, g, or t
  misc_feature (641)..(656): n is a, c, g, or t
  misc_feature (658)..(659): n is a, c, g, or t
  misc_feature (664)..(666): n is a, c, g, or t
  unsure (1)..(667): unsure at all n locations
cttgcgcccagatttgtaagcatcaacgattcttcgatgcaactaatgcccgttcttcttcactctgaacttttgatccccttttgaagctgaatgagaagctgtcagttaagaagccttctggtcaaattaagttgaaagttctaaaggntatatcaaaagagcatcaaattgtttgggataccactaagagtgagcaggagcttttgaaagttgacctcctgaagagttgattatatgcncngctgaacctctattgtgctgagatcaaagcttgtcaattctagtattaaagattagcgtcgctggttttacattaaaattagaaatatatactcaatatttacattttcatcttattataaaattagtggaagcactggtagagtagatttttggaagcanggttagtattacatattcccttgaaattattagtctatacttgatttgagattttaagtgaactttagaagtttataatggtacacaggcttcgattccaggctggctccaccactggaaatggcggcactggtgccggagtgggctaccaannagccctgnnnnatggggatcgatgannctnnncnnnnncctgtnnntnnnnnncgcnnnnnnnnnnnnnnnnnnnnnnnnannnnnnnnnnnnnnnncnnttttnnnt

SEQ ID NO: 1175 - DNA, 603 bp, Zea mays
  misc_feature (131)..(131): n is a, c, g, or t
  misc_feature (253)..(261): n is a, c, g, or t
  misc_feature (446)..(448): n is a, c, g, or t
  misc_feature (469)..(472): n is a, c, g, or t
  misc_feature (485)..(485): n is a, c, g, or t
  misc_feature (536)..(537): n is a, c, g, or t
  misc_feature (542)..(598): n is a, c, g, or t
  unsure (1)..(603): unsure at all n locations
cctaaggtgacaggctgctactctagattcttcatgccttttgtttaagctcccttgtgcctcacaagtggacacgaaggcaacgcaactgtgacatgcatgttagtattacaggcagctagctacagtcnttttcccttagtatataattaattaaactatgcagattgcgccgcgtcagcttggttaggtcaggtttcgccaggcctctctacccataccactgctctgaattatttgaccgacggccggnnnnnnnnntggtcctgggcccaaagaccagcttgtttgcctcgtactacaaagcctttccgacgtcaggactaaggaggactcaggaagagaagggcaggcagacagatctaatctaagcgtccatctttcgttcgatacgtacgtgctgctgctgctgcggggaatctcgcccctgccctgtctgcaacctnnntgtaaccacgaccgtcagctnnnncagccacagccantatccttatttactatagattagggcaaaactgagcccacttggacactgnnacttnnnnnnnnnnnnnnnnnnnnnnnnnnnnnnnnnnnnnnnnnnnnnnnnnnnnnnnnntcatg

SEQ ID NO: 1176 - DNA, 507 bp, Zea mays
catgcagatgttatcaagtatggttttaataacaatttgtttgtggcatcatctcttgtggatgtttatgcaaggtgtgggcagattgagaaagcctatctagtatttgctgacatgaaacaaaagaatgttgtcctgtggaacgcaatgataactagttttactaggcatggtaaatctttggaagcaatgattctctttgagaaaatgcagcagtcagggatatctccaaatgaagttacttatgtctccatgatgtcggtgtgtggtcatgcaggtttagttgaagaggcccgatgctactttgatctgctggttactgatcagactgttaaacctaatattgttcactattcttgcatggttgatgttttggggcgatctgggaagactgatgaggcttgggaactgattcaacaaatgccatttgaaccaactccttctatgtggggatctttgcttggttcatgccgtaagtacaggaatgtcggaatagccagactagca

SEQ ID NO: 1177 - DNA, 732 bp, Zea mays
  misc_feature (25)..(25): n is a, c, g, or t
  misc_feature (113)..(113): n is a, c, g, or t
  misc_feature (279)..(279): n is a, c, g, or t
  misc_feature (357)..(357): n is a, c, g, or t
  misc_feature (376)..(376): n is a, c, g, or t
  misc_feature (498)..(498): n is a, c, g, or t
  misc_feature (564)..(564): n is a, c, g, or t
  misc_feature (574)..(574): n is a, c, g, or t
  misc_feature (676)..(680): n is a, c, g, or t
  misc_feature (691)..(699): n is a, c, g, or t
  misc_feature (702)..(710): n is a, c, g, or t
  misc_feature (713)..(716): n is a, c, g, or t
  misc_feature (722)..(725): n is a, c, g, or t
  unsure (1)..(732): unsure at all n locations
ctgctccaagagaggagtgagggcnacaaggcctgcaggattatgaacaggagcctggtgtgcatctggcataccacgaacttgtacaggatcatcagcaacacgttgtacantcgcagccatatcagcaggagcatccaacagatcatcaacttcctgaagcagctccaatagaccggcactgagtcccaaggcggcctcacggaaggccccggtgtggcggagagctgcctgcgtaaacttcctctcgacgtcctcgagcacgccaagcctctggcnatcgatcaggccactgcctatgttctgtagcgcgtgggatatattgagcaccatcttcttcatctcgcaggcacttgnaacgcgatcgaaattagcnaagcagtaatagaaaggatgctgcattgcagcttcgatcgcatgtagcatgtcatcggcatcaccgaggtggagctgtgatatacagaactcagttagcagtccctggttcggcaatgtcancagcagccggaggtgatccaggcccctgatgcgtttgtacaccgtctccgtctccgtctcctgcgnctgctccacntccagtgaaacaaacgatgcgagcggcacgctggggtagtcgactgaactcgtgaggagctcgtccatggcgtccagatgcgctctcatacgctcggccagnnnnntgtatacctcnnnnnnnnnggnnnnnnnnntannnngagggnnnncgggccc

SEQ ID NO: 1178 - DNA, 588 bp, Zea mays
  misc_feature (1)..(24): n is a, c, g, or t
  misc_feature (73)..(74): n is a, c, g, or t
  misc_feature (488)..(493): n is a, c, g, or t
  misc_feature (502)..(502): n is a, c, g, or t
  misc_feature (507)..(509): n is a, c, g, or t
  misc_feature (513)..(515): n is a, c, g, or t
  misc_feature (517)..(520): n is a, c, g, or t
  misc_feature (527)..(547): n is a, c, g, or t
  misc_feature (549)..(552): n is a, c, g, or t
  unsure (1)..(588): unsure at all n locations
nnnnnnnnnnnnnnnnnnnnnnnnctgcagagccttttttacaagctccagtatagcgacaacagtgtagcgnngaaagagttgaccaaatcctttggatgggatacttatgattctttcatgcagcatgacgtgcaagaactcaacagagttctttgtgagaaactggaagataagatgaaggtaaatatgaaaataatgaattatcaatacatctaaaaggacagaccgagtgttgtcagctcccacatgaatggggtctagggaaggaataaccgaggcaagccttaatcccgtattcttaaagagaggctgcgtcagacctttgactcagtgggaagacttctcaccactacgctaggcctgccctttgaattatgaatacagcaatttactttttattaactttctttctccacagggaactgttgtggaaggaacaatagaacaattatttgaaggccaccacatcaattacattgagtgcnnnnnngtggactanaaatnnngcannnannnntcatttnnnnnnnnnnnnnnnnnnnnntnnnnttgatgaaaaccatatatttatctatgatatataaa

SEQ ID NO: 1179 - DNA, 637 bp, Zea mays
  misc_feature (38)..(38): n is a, c, g, or t
  misc_feature (520)..(521): n is a, c, g, or t
  misc_feature (550)..(550): n is a, c, g, or t
  misc_feature (552)..(556): n is a, c, g, or t
  misc_feature (561)..(563): n is a, c, g, or t
  misc_feature (565)..(565): n is a, c, g, or t
  misc_feature (578)..(588): n is a, c, g, or t
  misc_feature (597)..(597): n is a, c, g, or t
  misc_feature (599)..(605): n is a, c, g, or t
  misc_feature (608)..(608): n is a, c, g, or t
  misc_feature (614)..(615): n is a, c, g, or t
  misc_feature (617)..(618): n is a, c, g, or t
  misc_feature (621)..(621): n is a, c, g, or t
  misc_feature (627)..(636): n is a, c, g, or t
  unsure (1)..(637): unsure at all n locations
tccttgctgtacttgaacaaagtcagtgcatctgtttncattgcagctttagccgtgcccaaactagtattcggagaggcttttacacctgatgcagttagatcatcaaaatcaagatacgcatgccactgctcatggaaggttagtgactctccctgatctgctagatggataatatttgtttccatactaacaggagtcatagcagtactcttatcctccactggttgcatcagagatgctattgctctggagttattttcctcttcatacaattgcaaattcgtattttcatcctgaactgatgttctggaggactgaatatttgtggctccatttgccgcattattgttttcacaattgtttgatatattgttaggtgcatctgcttcttcatcagattctgatgattcataagcagaagccagaagcccaagagcggaagtgcatccatgggtgctgctgctgtatagctgtctacacctatcagaaacttgggctgcactcacattttgtattnnattatcatcagtttgatgagcatatcctntnnnnnaaaannngntatatttacacgnnnnnnnnnnnactatgcantnnnnnnntantttcannannatnaaaaannnnnnnnnnc

SEQ ID NO: 1180 - DNA, 598 bp, Zea mays
  misc_feature (405)..(405): n is a, c, g, or t
  misc_feature (416)..(455): n is a, c, g, or t
  misc_feature (459)..(597): n is a, c, g, or t
  unsure (1)..(598): unsure at all n locations
agaaaaagttttcacttcgctcatcaagtagaaaacccaaaaaccaagactagttatgaagaactccattaaaaacgtccaagcaagaaacaaaaaaaaaagtgctgggggaaacaagagcctcaaatccacaatgatgtgcacatctttgtacatgcagtatgcttctgaagtagagattagtaagaaaaaatttgactttacttctcttgtaaaagcacaccccacccatgtacccttaaattcgctgcctggtgaggaagacaggaagtaccgtgtcatatcctgatcaaatttgctactcaaatcagagttcaagtttaatcaatagtccaatcagaacctccaggtacccagaatggtgagctgattcatttattaaaagggcagacccagtgacggaanctcccacatgnnnnnnnnnnnnnnnnnnnnnnnnnnnnnnnnnnnnnnnntaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 1181 - DNA, 656 bp, Zea mays
  misc_feature (167)..(167): n is a, c, g, or t
  misc_feature (576)..(577): n is a, c, g, or t
  misc_feature (585)..(587): n is a, c, g, or t
  misc_feature (616)..(619): n is a, c, g, or t
  misc_feature (623)..(624): n is a, c, g, or t
  misc_feature (628)..(628): n is a, c, g, or t
  misc_feature (636)..(641): n is a, c, g, or t
  misc_feature (647)..(648): n is a, c, g, or t
  misc_feature (650)..(650): n is a, c, g, or t
  misc_feature (653)..(655): n is a, c, g, or t
  unsure (1)..(656): unsure at all n locations
ggccagcatcacgcggcggacggcgggcgtcggccggagcaggatctcgcgccgcacgctcgccgacgacggcgcgtcgccgccgccggagcccgcctgcttcgtggcctcctgcacggacgtcaagatctcctggagccggcggtccgcgtcccccaccgtgcgcnccagcacgcggcgcgcctcgtcgcggtggccgtggaggacgagccagcgcggggtctccggcatggcaagcgcggccgcggccgctaggaatagaggagggacggcgccgatgccgatcatcaggcgccagttgagtggcgtcgggaggccggcgagcgcgaagtcggcgatgtagctcagcaggatgcccgagttgccggcgatctgacgtcacaaagcatgattataggtcacaagaaataataataactgtcaatcgtctcgatcgcatctaggccatttcctaaaagctgtcatcagctgtggcccccaaaagctggcgtccagtttgccactgatctagacctttttcctaaaaccatgcgcgcgcacgcaaaacctctcgtggaaaaaaaatgcaagtgaatnnaagaatgnnngtggaagatgtgaaaaaaaaagcatcatnnnnaatnnaatnaagcatgnnnnnnttgatnngntgnnnt

SEQ ID NO: 1182 - DNA, 723 bp, Zea mays
  misc_feature (43)..(44): n is a, c, g, or t
  misc_feature (50)..(50): n is a, c, g, or t
  misc_feature (57)..(57): n is a, c, g, or t
  misc_feature (63)..(63): n is a, c, g, or t
  misc_feature (88)..(88): n is a, c, g, or t
  misc_feature (133)..(133): n is a, c, g, or t
  misc_feature (173)..(173): n is a, c, g, or t
  misc_feature (241)..(241): n is a, c, g, or t
  misc_feature (392)..(398): n is a, c, g, or t
  misc_feature (423)..(423): n is a, c, g, or t
  misc_feature (499)..(499): n is a, c, g, or t
  misc_feature (508)..(508): n is a, c, g, or t
  misc_feature (574)..(574): n is a, c, g, or t
  misc_feature (581)..(582): n is a, c, g, or t
  misc_feature (607)..(607): n is a, c, g, or t
  misc_feature (625)..(625): n is a, c, g, or t
  misc_feature (656)..(656): n is a, c, g, or t
  misc_feature (661)..(662): n is a, c, g, or t
  misc_feature (668)..(670): n is a, c, g, or t
  misc_feature (672)..(672): n is a, c, g, or t
  misc_feature (677)..(677): n is a, c, g, or t
  misc_feature (684)..(698): n is a, c, g, or t
  misc_feature (704)..(708): n is a, c, g, or t
  misc_feature (710)..(717): n is a, c, g, or t
  misc_feature (722)..(722): n is a, c, g, or t
  unsure (1)..(723): unsure at all n locations
caacagaaaacagttgctgccagaaccaatcaggcgatcatcnnagcagnaaatggncagacncaggccatgcaatttaaaacaaggngataccatttaacgaatgagttatgcagtgaagtgatgatgcatngcttagttttggtggtccagcaacaatgaagtcaattaangcaatcatggaccattggatcgtgagtagtgagtacaacacaacagtagggcattcaacatcagtcangaatcctgagtagtacaacaacagtagggtgttttacaccaatcatgagccattagaagcagaggatggggcttaggagatgatatcaccaacatacataattcacaatgggcgaggaaatcacctttggaatgatgagcaaaggatatgnnnnnnnaaagtacaaggagaaacacaatgtncacctaccgaaacctgaaattccatataattgcattggtttccatttccttcatttctctcacttgcggggaattntaaatggtngtgcaaatctcaacacctacactaaccaactccaacagaatgtatcaccagtaattaccagcgagntatgaannttggtagatgtagttagctgtagangcaactggtgaatcacancaaaaaaacaaaaaaaatggcacctttgatntatgnntatgtnnntnctagnctaccannnnnnnnnnnnnnngctgtnnnnncnnnnnnnngatgnc

SEQ ID NO: 1183 - DNA, 738 bp, Zea mays
  misc_feature (240)..(240): n is a, c, g, or t
  misc_feature (413)..(413): n is a, c, g, or t
  misc_feature (425)..(425): n is a, c, g, or t
  misc_feature (505)..(505): n is a, c, g, or t
  misc_feature (615)..(618): n is a, c, g, or t
  unsure (1)..(738): unsure at all n locations
ccagtttctatgattatcactcattaattaatcagagatgctgtttgccacaaaatgaagcaatatggtagccctattttcacttcatatcagaaattcaactcctagtttatatttacagactacagaagcattagatcaatcgaacaactataggactgatagtatcttaaaaatcaaatgcatgatctacaacacagcagtagatgttgattaaaataatgcataacaattcggtanaatactaaataccaacattaacaacactagaacaaaaacatacttaggacatggaagattccatcaacagcacgtatatgtgagaggaatgcattgcccagaccatccccagcatgagcacctctaataagcccagctatgtcagttacttcaagatatgcaggcacctgcanagaatttcaacnaccacaatgcacatgaaacacgatttgaacagtcattgtacatctgatgatctgaaacataacctcagaaagagaaatgngatttttactttctgggtgggagcagcagaacattttttttcaaaacttagtcaaattcaaataatttcaatagaaactgtaggggcttaaaggggtcctgccccccccnnnntcctctctgtcactgaatatgggtaaagaaaagaaacaaacctcactctttggcttgtaaagtttgcaaagccaatcaaaccgttcatctggaacattcacccgtgcttcatttggttcg

SEQ ID NO: 1184 - DNA, 647 bp, Zea mays
  misc_feature (16)..(16): n is a, c, g, or t
  misc_feature (44)..(48): n is a, c, g, or t
  misc_feature (87)..(88): n is a, c, g, or t
  misc_feature (92)..(95): n is a, c, g, or t
  misc_feature (118)..(118): n is a, c, g, or t
  misc_feature (519)..(519): n is a, c, g, or t
  misc_feature (546)..(548): n is a, c, g, or t
  misc_feature (611)..(613): n is a, c, g, or t
  misc_feature (615)..(617): n is a, c, g, or t
  misc_feature (621)..(628): n is a, c, g, or t
  misc_feature (637)..(637): n is a, c, g, or t
  misc_feature (640)..(646): n is a, c, g, or t
  unsure (1)..(647): unsure at all n locations
gccctggctgcatcanacgctgatcctcccgactggtccatgannnnnttatgtaaccccatggcaggaactggttgaagtggcggnngagnnnngggtgaccttccagaagcacctncacacgctcaaccacaaccgcactacgaatgctgcaattcacagacaagacgaataaagaatcgatcgacctgacaatcaaagaaaccaaatgaaccctagttaacacagcatccaaggaagccagagccactactgcaatagcaaaggatggtgtggacggtcattgacctcccggacttgaactggcgcatggtggcgatgatctcgtcgtacttgtcaggctcgcaggcgaacacgcgcttcaagctcgccacgaaactgagtccatcttggactgtctgcgttggcctcctaatgtcatcatgcggtggagacaaatgcatcgatcaggatgcatgggaaaacattggatcacatgcaagtcaagcgagcaaaaccacagaaattaataaagggggngaaatttctttgaaccaggactccgannncgcggcagataacggaggaggtaggtgaagttaactaaggagagaagctactcacggatcacnnncnnngagnnnnnnnnacacaccangcnnnnnnng

SEQ ID NO: 1185 - DNA, 869 bp, Zea mays
  misc_feature (1)..(10): n is a, c, g, or t
  misc_feature (17)..(18): n is a, c, g, or t
  misc_feature (84)..(84): n is a, c, g, or t
  misc_feature (204)..(206): n is a, c, g, or t
  misc_feature (315)..(316): n is a, c, g, or t
  misc_feature (321)..(321): n is a, c, g, or t
  misc_feature (437)..(437): n is a, c, g, or t
  misc_feature (449)..(449): n is a, c, g, or t
  misc_feature (542)..(542): n is a, c, g, or t
  misc_feature (816)..(820): n is a, c, g, or t
  misc_feature (822)..(832): n is a, c, g, or t
  misc_feature (834)..(868): n is a, c, g, or t
  unsure (1)..(869): unsure at all n locations
nnnnnnnnnntaagtgnngatgacggtgtatggcatcaccgcaaaaaatgggtttgagcatgaagcagcaccggttgggatcancttgctcaggcaacaacgcttcaagcatgggactgaatatggacaggattgtctccagcaccaccttgtcgctttccttcatctgaaagcacaacgagaaagatgtgatttttagatgannnatatgtcgatcgaacgatgtggcctgtaccgtgattcatgggaccatcacagcacccttacatcagcctccgcagcgggttcgtctacctcacagcctagagcagcacnnagatnggtcagcaagggctgaggcaggccatacgtggggaatcctccggatgtcgacagccatgtcccacgaaccatatgagttgtttggcttgtagtcgccgaagactgagctgtgatgncctcgtcatccncggatgtgtcaagatctgcatgcatgtaatcgtgcatctgttaaataaagggtgcacaaaatctgttgatgtcaaacggggaacctgctgttnatggaaactgtgcctagtccctgatcaattgaaatggctatgctggttggacagaaatcgagatagccagactgaactactgtaacaggtaaaagttacgttaggtatttcaaatctaggccaaccgacatttcattggcaagaacagagcaaaagtaacctctctacttgctgatctacatgcagccaggaatacaactgccgtaacagattacctaaaggtataacatcataagggttgtctcctcttggtaggaatccatagaacgtaagnnnnngnnnnnnnnnnngnnnnnnnnnnnnnnnnnnnnnnnnnnnnnnnnnnnc

SEQ ID NO: 1186 - DNA, 364 bp, Zea mays
  misc_feature (7)..(8): n is a, c, g, or t
  misc_feature (181)..(181): n is a, c, g, or t
  misc_feature (198)..(198): n is a, c, g, or t
  misc_feature (219)..(219): n is a, c, g, or t
  misc_feature (224)..(224): n is a, c, g, or t
  unsure (1)..(364): unsure at all n locations
gcagtcnncaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctcncccttttgtattcctgnttttttttgccgttttgtganttccntccttgccttattggcaagccagtatttacccgactcgaaaggacaatgtgatgttgtattttagcctcacagaaaggtattactaacctttgatgtcactgcagaagtcgacaccatgttagaaatttagttcattcgt

SEQ ID NO: 1187 - DNA, 576 bp, Zea mays
  misc_feature (194)..(194): n is a, c, g, or t
  misc_feature (402)..(402): n is a, c, g, or t
  misc_feature (419)..(419): n is a, c, g, or t
  misc_feature (440)..(440): n is a, c, g, or t
  misc_feature (443)..(443): n is a, c, g, or t
  misc_feature (480)..(480): n is a, c, g, or t
  unsure (1)..(576): unsure at all n locations
agtagagacaccaaagacatttaccttgggacctttggtgagtgaagtgctgtaatataccatgtctaccttgtgggatttccaaaggttttctatcaactagaaagcaactgtcagctgatgcagttatctttaattgaaattgatatcggtttgcagaaactgaagaagaggcagcagaagcttatgacatngcagcgatcgagcttcggggtgttcatgcagtcaccaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctcncccttttgtattcctgnttttttttgccgttttgtganttncctccttgccttattggcaagccagtatttacccgantcgaaaggacaatgtgatgttgtattttagcctcacagaaaggtattactaacctttgatgtcactgcagaagtcgacaccatgttagaaatttag

SEQ ID NO: 1188 - DNA, 1259 bp, Zea mays
  misc_feature (1016)..(1042): n is a, c, g, or t
  unsure (1)..(1259): unsure at all n locations
acatcttttatctattatctatcgtgattcaattacacgaggcttgaaacaaacactatgcaatggcatctataaataagtcacgttacaatcgtccggaccaaccccttcatcacaaactacagtctttcggcatcttgtgcatctataccaatcaacctctgtttcatgaacagagtgctatgtttctttttagttcagaatgtaccatatatctaataacagaggcacagggccgaagcagctttagcacactcagtctttatcattgacggcttcttcagagtctctaagccactcacgaagcttcagctcctgctcttctttgaacttgttgtaagcctccactgtttccgagacgccggtagcaggcaggctacggtttgcggccgtaccctctgacaaccgacttgaaatggggagctcatccttctctgtatctggtgtagatgcaccttgcccaccagcttgtggcgattccagggcagaagacgacgccgagttctcgctagtatcatcttttgttgcaaaatcaggctgcggccacctgagacctgatgccttttgcttcgcggtgttgaacattgaagagaggtagttcctgctgctacttccattggtagagcccagttcgtcccaagttcctgagcttttccttgactggaacccccaactggggttttggatcaaccctctctttggctgggtctttgacattatttgcagtgatctatttatgtccttgatcatgtcatcagcaagtggaagtccaaaatcagccatggatctcacagcacaaatagaatcctccatgtcttcagtgtgcaatgtcacctcgcgtgtcttctctacgagtttacccttgacgtcaaggaggaggggcatggaagcccgggcgtgctgctggacgaagtagagcccgacggagggctcgttggcgacgtacttgatcattccgtccacgccgtccttcacgcgcaggaagccgtcggcgggggagagcggcaacgacgaannnnnnnnnnnnnnnnnnnnnnnnnnnttgtgcatgtccgcgcccgccggccgccgaccatcacggactcgccgccgaccactcagcgaggggttctcagattcgccgccgcgtcggagaacgaacagatgcgaaaaaatatcgatttgggagcctccccgtctagagctccctctttctctctcctgcggggatggaggccgaagaacagacaaattattgtgtccggtcccttacccctccg

SEQ ID NO: 1189 - DNA, 430 bp, Zea mays
cgcgcgagcatccaagaactgtggctcctttccatggttcttctagcgtcgtcctctcttgtctgtgcaagcatggcggtagatggtaactttcttctgacgtgaatatatacatacatctagtgttcataattctaactgacagaagaagcgcgtgtaactcgattgaccatattgctagggcaaaccaaagaggacatcaacgcaacgaatgtgacgagcatgaacatgacgaggtcgtcgtcggcgagctacaacatgactggcggcggcggagaacttaacagaggtccgtgcgtcgtgagatctggattctactggtgccagaacattggctatccgaccatgtcggagtgcttgaagaactgcgaatcgtaaagcactggagtatagaaaaggaataaagtggtctctgctagcttaatttctc

SEQ ID NO: 1190 - DNA, 613 bp, Zea mays
catggtcaacatcatttaaaagtgcatatatgcctccttgtcgttcaacagaagataaaccccctccccagcgcataacacgtgataggtcatttccagttccgagaggaagaatggcgacagggggaggagattcgtagttctgcttttcaatagcatcaagaacccatgctacagttccatccccaccacaaacaaggattctgaagtgtttcacattgtggaatagttgtaatccaacttcaggtgcctgagaagcacttagctcaaatatctgaaacaagggttgtaattttcaggtcaagctaagagcattaaatcagttgcaatcaggagtgccaataaacgaattaagtaaccatattttaactacaacacgtatggatagatttcagtgcctataataaaatgcaagtgcatacaaaagaaatgcaagtgcatacaaaagagaaaacataaagcacgattactacagcagaatagtgctaaatggtgacaggtcgttcagtacttatatcaggtagaacaattggattacatctgtacatctacaattctagaatgacctaagctaaactattgttcaaaatatttcagaggatttgactcagca

SEQ ID NO: 1191 - DNA, 607 bp, Zea mays
  misc_feature (2)..(2): n is a, c, g, or t
  misc_feature (200)..(200): n is a, c, g, or t
  misc_feature (276)..(276): n is a, c, g, or t
  misc_feature (349)..(349): n is a, c, g, or t
  misc_feature (352)..(352): n is a, c, g, or t
  misc_feature (360)..(360): n is a, c, g, or t
  misc_feature (374)..(374): n is a, c, g, or t
  misc_feature (376)..(376): n is a, c, g, or t
  misc_feature (389)..(389): n is a, c, g, or t
  misc_feature (423)..(423): n is a, c, g, or t
  misc_feature (456)..(456): n is a, c, g, or t
  misc_feature (501)..(501): n is a, c, g, or t
  misc_feature (514)..(514): n is a, c, g, or t
  misc_feature (567)..(567): n is a, c, g, or t
  misc_feature (569)..(569): n is a, c, g, or t
  unsure (1)..(607): unsure at all n locations
cngccgacatggcggcttcgggagggctcgagcagtggcagaaggacgggttcttccaggcggccgaggaggtgcaggagtccgcggacttgtgagtgccttcgtcatcctggcttcgattcgttgcgccaggggcttcaaaacttttaactttatgtatatatatgcatgtctacctcttggcgattgtctttgccgtnaattttgatcgatccctttttcgaaggttggattgctgttcctttattttgtggattatgggtgtgctgtgtttangatgggattctgatctgaaccgtgcttgttcgcggtccttgcagactcgagaactctagactcttgaattttntantaattttntattaagtgattgntnggctaggttgtgnattgtgtaagatgagatttggatgcttattttcnctctgattggttaactgctggctctatttgtcngttctctccttctattagttgagattgtgatttcgtaaaaaaaanctggttctttggnggcacctcatatcttattgggttcatttatgtcgctattttgtattgtatggntnggccaagtagtgctctgttctaatcaagtcagctttgc

SEQ ID NO: 1192 - DNA, 705 bp, Zea mays
  misc_feature (530)..(530): n is a, c, g, or t
  unsure (1)..(705): unsure at all n locations
gccggcatccgcacttcctaacaaagaagttcagtatgtccttatcagatatacatatattaataatcatgtaactaaaaacaaaatgtggccaactcagtgaaggggcactgaaaagactatgaacttttgcagagcagaccaatctaaacctccaacttactatggacgagattcttctcttagagataataaattgcaaagataataataataataacaacaaactaaatagatttacaaatagtacttcatagatgcatacgccaggtagattgtgcacataaacacttttaggaaagagtggcttccaaaggcaataaccatggcaacaattctaggatgagctgtttcacaagtggtggagaagttctaaattctgatgcccacaaccacagcccatgggcaagcaccaacagcaacattagaccatttactccctctgtcccaaaatactattcgtttttagcccttggttttatgtttatattcaaatcgatggtaataaatctagacacatataaaaacancatacatcaaatatagtatgaatccattatcaccccaaaatgaattttaatttgggacagagggagtattatttatagtactccttccacgccattttggcttgcactatatgtatctagaagaaccaaaacaacttataatttaggtcttgtttatttccttacaagattatat

SEQ ID NO: 1193 - DNA, 1478 bp, Zea mays
gcacagtggagttggcaggaaaggcatttactggcaatcctggcaagaccaagaagcaagctcaaaagaatgctgcaatggctgcctggtctgaattgaagaaactgcccagggtaggtgagccgtcatcctcatcttgtccacctgatcaggatgatgaagtgcaggaacaggtcgtagttactcggactcttgcaagcttgaaccaggcaaatagtggcaaggtgccacatcagaaggaaaaacagcaaagcaataaccgcccatcatcacggagatgttatcctaaaccaaatacaccattctaccgaccatttatgcaaaatcaggcttatcctagcgttccaccagatcaagctatgtaccatctgtggcatcggatgcaagtgacagccaacgcctcgctttccagtggtaccagctatgggcaatacaagtttttgcccaccagcagctatgctccccatgtaccctccttcacctcaagggcaattctccaatccggctaaccaggatgctctaggccttcttccatgttttcctgatgcttctcctgccatgctacggcacttctcaccttaccctgtctcctatgtgccaagaagtcctctgccggttactgttcacaatgttcatgagagaaggcatgaccatactgaaacagttgagcttcctgatgctgtggtgttctcccaatgcacgaccctagattcctttaggacatcagaatgtggcggtccaccactcaaggttcaagaaccaaccaaaaatcggaaagaaggctgtattgggtcccctgagaaagaacttgacactcttgccgtctcaagctctaccgcacaagcgtcgtcgcaaaagttggaagcaaatgaaggtaagcaaacagtgcaggcaggtttgaagcagacccatgaacagcagctgatgtcatcctcgtcttgtgttagttcttcagttgtggcacagagctcgcattacgctagctccatccagcatgaggagtctatacatagaaggaatcctcctcatactagttcgcctgcattgcctgatgtgtggtcttcccgctcgcaagctctgcccagatttggatcaccaagttgggtgttccagcagcgaccttggttggctgcacccgtcacagttcgaaccgctgttcctgtctgctcagccaggccaaacgtggtgaattctaccactggaataagacctgctgcccagagccatgatggagagagagatctgaacagcgccgcagcagcgagttctggattcaataaactccaaatttgagctgcggttttggttctgctgagcttttcatctcagttttgtttgcttcttggcttgaggtttattttttagttagatataccagataggctcttaggttttcattttacatttaccagatgtccagttccttctgaagataaatggacgagaactgtaatataaaaaatgcagaggccttctcc

SEQ ID NO: 1194 - DNA, 460 bp, Zea mays
  misc_feature (13)..(15): n is a, c, g, or t
  misc_feature (84)..(84): n is a, c, g, or t
  misc_feature (130)..(130): n is a, c, g, or t
  misc_feature (216)..(216): n is a, c, g, or t
  misc_feature (225)..(225): n is a, c, g, or t
  misc_feature (331)..(331): n is a, c, g, or t
  misc_feature (336)..(336): n is a, c, g, or t
  unsure (1)..(460): unsure at all n locations
atgttcattcttnnngacgggttgtcctttgaacatgagacaccaactcgtatcacagaagctaagcaactgagcatctcaggntcatggtcatacagctccgcattgaaaagttctgggtcaatgattnctgataccctgtcaggtaaccctgcctcagcaaacaagtgcagggtcaagccttctatgaacatgtcatcagttggtgctttcccngtgaacatntcaagcagagtgaccccaaagctgtaggcatcaccagcaactgatgcttgaccacctgctccatattctgcaggaatggaaatattatgacaagttgacaatgccntaaanagatgatacagtaagggcaccaaatcaaggcagtttattaattgactagaaaaaaaatgtggtttctgaatggtggacgtacctggagggacgtatccagtggttcctcgtatccgaatagtgc

SEQ ID NO: 1195 - DNA, 590 bp, Zea mays
  misc_feature (395)..(396): n is a, c, g, or t
  misc_feature (446)..(447): n is a, c, g, or t
  misc_feature (508)..(511): n is a, c, g, or t
  misc_feature (514)..(522): n is a, c, g, or t
  misc_feature (531)..(531): n is a, c, g, or t
  misc_feature (539)..(540): n is a, c, g, or t
  misc_feature (563)..(567): n is a, c, g, or t
  misc_feature (573)..(588): n is a, c, g, or t
  unsure (1)..(590): unsure at all n locations
aaattgtacattgcggtcggtagagcatacaataatgcaaggagccaggagatcctgacatgctacattcaacaagaaccactatatcagctccggtcctacatttatcatcacggcgacctttggcacctgaaaaatacctggcagcattggacggatcacatctgcatgtctattgtaagagaagatgcggtggctaccttctcccttaggttgaacttccttgctatataaggcctgacatcttcaacgccgaccaagctttctaagaacgggagcaatttcagcagctccatgtcattgggatcatcaaaccagctttctataggaatgccattgtccaactggaacccaaaggcctgcaacgaggaaagcggctttacatttaaatcctnncaaaacccaacaagtgaacaactaaaagctaattcaagatgaataatgcnnatgtactgataacagctgcgcatgatccaaaagatcaatgatgatggatgatagatttcannnntannnnnnnnnctgctactnctaaaaannaaagacactcacactcagcatcnnnnncacatnnnnnnnnnnnnnnnnat

SEQ ID NO: 1196 - DNA, 401 bp, Zea mays
  misc_feature (5)..(9): n is a, c, g, or t
  misc_feature (46)..(48): n is a, c, g, or t
  misc_feature (58)..(63): n is a, c, g, or t
  misc_feature (99)..(104): n is a, c, g, or t
  misc_feature (113)..(115): n is a, c, g, or t
  misc_feature (291)..(298): n is a, c, g, or t
  misc_feature (300)..(300): n is a, c, g, or t
  misc_feature (307)..(326): n is a, c, g, or t
  misc_feature (328)..(335): n is a, c, g, or t
  misc_feature (343)..(344): n is a, c, g, or t
  misc_feature (348)..(350): n is a, c, g, or t
  misc_feature (355)..(367): n is a, c, g, or t
  misc_feature (369)..(375): n is a, c, g, or t
  misc_feature (377)..(377): n is a, c, g, or t
  misc_feature (379)..(385): n is a, c, g, or t
  misc_feature (389)..(400): n is a, c, g, or t
  unsure (1)..(401): unsure at all n locations
tttcnnnnnaacaaacatataatacacaatattacagtgcttactnnnaaatatcgannnnnnaaactgcgtcacttgggatgtcgataatgccagcannnnnnacatgcagnnnaacatttgaaactgagtagtgagcacatccacattgatacctagaatgaggcttcaaacattacaatgttaaaacaaataaacaatatgagccaagaaagaactccatatattattttgaagcaaaaatttagcttgtaacgtaagatattgacagtaccttgacgaactgactgnnnnnnnntnttggcannnnnnnnnnnnnnnnnnnnannnnnnnntgaacgannatgnnntttcnnnnnnnnnnnnngnnnnnnnantnnnnnnnatgnnnnnnnnnnnnc

SEQ ID NO: 1197 - DNA, 728 bp, Zea mays
  misc_feature (2)..(2): n is a, c, g, or t
  misc_feature (330)..(361): n is a, c, g, or t
  misc_feature (413)..(413): n is a, c, g, or t
  misc_feature (470)..(470): n is a, c, g, or t
  misc_feature (717)..(717): n is a, c, g, or t
  misc_feature (719)..(721): n is a, c, g, or t
  misc_feature (724)..(726): n is a, c, g, or t
  unsure (1)..(728): unsure at all n locations
gntggtgcgatcaggactagcttgttctggccaccagcttgccagctgccgtctcctgcaatcccaagcggagatgaatcggtaatgaccaagttaatgatgctctgcactcgtgtagcacctatgtgttatgtccttgtaatgttatatttacgccaaggtttgcagttcgtaggttgtctcctgtaggtaaattgtgcagggatggagaataggaaattatgaaacaccagtacatcgatcatgcgaataagaactgcacagtctaaatccaagtagtaattcactgtctatctgttacttgggagtataaactttccttggaatacnnnnnnnnnnnnnnnnnnnnnnnnnnnnnnnncaatagagctaaaacacctgctttctactaactgatgcctatattaccaccngatattcacaagctaaaattctatatcactttcttgctaactgttatttctggtacnttgcttatacacaggtggaacaactgtggcacagttgtgctctggacttgaaaattcctcaagatgttagaaacaggtcccattacagccttctgttcaacaccatcagcaattcgtatagagaaaatgataataagttctatcctcaaaagattggcattgaggaagcaatcaccgcaaccttatcacctgcaaaagatgccaacacttttctggactgcttaaagaagcataatttccctttctntnnncannnac

SEQ ID NO: 1198 - DNA, 749 bp, Zea mays
  misc_feature (36)..(36): n is a, c, g, or t
  misc_feature (42)..(42): n is a, c, g, or t
  misc_feature (47)..(47): n is a, c, g, or t
  misc_feature (118)..(118): n is a, c, g, or t
  misc_feature (136)..(136): n is a, c, g, or t
  misc_feature (159)..(159): n is a, c, g, or t
  misc_feature (161)..(161): n is a, c, g, or t
  misc_feature (184)..(184): n is a, c, g, or t
  misc_feature (214)..(214): n is a, c, g, or t
  misc_feature (224)..(224): n is a, c, g, or t
  misc_feature (318)..(318): n is a, c, g, or t
  misc_feature (398)..(398): n is a, c, g, or t
  misc_feature (409)..(409): n is a, c, g, or t
  misc_feature (454)..(454): n is a, c, g, or t
  misc_feature (520)..(520): n is a, c, g, or t
  misc_feature (610)..(610): n is a, c, g, or t
  misc_feature (640)..(640): n is a, c, g, or t
  misc_feature (748)..(748): n is a, c, g, or t
  unsure (1)..(749): unsure at all n locations
cccctgcaaatcagagttcttattgtcagataaaanaggaancagtntgttcgcaacaacatttactcactcttgattatacctcataaattcaaggcatcgatttcttatcttatgngaaaccggttgtcggctnaaatcacgtcactaaaagaaaananatatatatctcaacatctgatantgacgaagccattcttctttctatattttnagcagagtantatgactactacagaactttgaccagtaccaaacaatcggctgcaaatgcatggctacaacggaatctcaacacctcgctgcaaatgccatcancctcttctctctttttcgctgtaccataacaattgactagtacacaatttaaccaataaatcctcgcagacaaagaagcnggaaaaaaaanagaaactaagaacatcgtattattcgttcgctgtgaactgaatanctccatctccagaagacaaaagtgcagagctataaacgctggagggagcaaagccatggctcctanaagaggagctgatggtcacaagaaagttctcagtcttccgcggtgccatggccacgaggcgaggcctctgtgtcaccagcattgtcggcngccaacctttcctcaagaaccctctcgccncgctccctggaaataacgattgagatggaattagtcagctcgtaaaaaagcgataccaagagttgtttctgagactccagatatttctcgataacacagttttggtcnc

SEQ ID NO: 1199 - DNA, 556 bp, Zea mays
  misc_feature (118)..(119): n is a, c, g, or t
  misc_feature (196)..(197): n is a, c, g, or t
  misc_feature (199)..(199): n is a, c, g, or t
  misc_feature (232)..(232): n is a, c, g, or t
  misc_feature (445)..(447): n is a, c, g, or t
  misc_feature (450)..(450): n is a, c, g, or t
  misc_feature (467)..(469): n is a, c, g, or t
  misc_feature (481)..(487): n is a, c, g, or t
  misc_feature (490)..(500): n is a, c, g, or t
  misc_feature (506)..(511): n is a, c, g, or t
  misc_feature (516)..(523): n is a, c, g, or t
  misc_feature (526)..(526): n is a, c, g, or t
  misc_feature (530)..(555): n is a, c, g, or t
  unsure (1)..(556): unsure at all n locations
tgttgccggatggaatgtcatcggcttcatattcccgttcctcgtggcggagtccaaggggtagaggagatctccggcgagatcgaggacagcagcacctgccagcgcaaccagcggnntgtgccgacagatttgaatgaataaacaagggtcctacttgtacttccgtaaagctgtgtatcaggaccactattannanatttatggaacaagaaacgagcacatttctggntacaaaatgatgcaccttatgcttacagtgcacagtagacaatggtttcctcctgctacgaaacgagttacactaccaaggaacccaagaccaaaggggtaaaatacagaatcaaggtgaagggactacaacttgctagcctcacccccaaatcaagcaataaaaaaacacagatgattagcgattaatgatgatagcaggtattgctgattnnncangtaaatcgaatgtcatnnnataaattataannnnnnnatnnnnnnnnnnncaaaannnnnntgaannnnnnnngtntacnnnnnnnnnnnnnnnnnnnnnnnnnng

SEQ ID NO: 1200 - DNA, 571 bp, Zea mays
  misc_feature (47)..(48): n is a, c, g, or t
  misc_feature (56)..(58): n is a, c, g, or t
  misc_feature (138)..(138): n is a, c, g, or t
  misc_feature (255)..(255): n is a, c, g, or t
  misc_feature (270)..(296): n is a, c, g, or t
  misc_feature (326)..(388): n is a, c, g, or t
  misc_feature (410)..(411): n is a, c, g, or t
  misc_feature (429)..(431): n is a, c, g, or t
  misc_feature (445)..(449): n is a, c, g, or t
  misc_feature (453)..(453): n is a, c, g, or t
  misc_feature (486)..(487): n is a, c, g, or t
  misc_feature (493)..(499): n is a, c, g, or t
  misc_feature (504)..(509): n is a, c, g, or t
  misc_feature (514)..(525): n is a, c, g, or t
  misc_feature (530)..(535): n is a, c, g, or t
  misc_feature (539)..(549): n is a, c, g, or t
  misc_feature (554)..(557): n is a, c, g, or t
  misc_feature (569)..(570): n is a, c, g, or t
  unsure (1)..(571): unsure at all n locations
cttgctagccacgggaggatccccgtcctcgccaccatacatgtcgnnctattgtnnnctacgtgccttgccccgatctgtgccgtacagtgactccctagcgttcgggacgatgacccatggtgaccctgaccaacnatttgggacgatgaccctgggccatggaacgcggcatcgaccctgtttcctatgactatgctttgaccatgtttgtaaaaaaacatgcacaaaaatctacaacatcaaacaagattnattagatacaccatnnnnnnnnnnnnnnnnnnnnnnnnnnntgatattatatatgctacgataaactcgannnnnnnnnnnnnnnnnnnnnnnnnnnnnnnnnnnnnnnnnnnnnnnnnnnnnnnnnnnnnnngtatattcaaaccacattagcnnaataggggtgatgtctcnnntgaaatttaaagannnnnctcnataaagctagatcaacctcaaatacttattgcnnctcacnnnnnnntgacnnnnnnatgcnnnnnnnnnnnnactgnnnnnnatannnnnnnnnnncatgnnnnactgatacacannt

SEQ ID NO: 1201 - DNA, 328 bp, Zea mays
  misc_feature (26)..(26): n is a, c, g, or t
  misc_feature (156)..(159): n is a, c, g, or t
  misc_feature (182)..(182): n is a, c, g, or t
  misc_feature (201)..(201): n is a, c, g, or t
  misc_feature (213)..(213): n is a, c, g, or t
  misc_feature (227)..(227): n is a, c, g, or t
  misc_feature (238)..(238): n is a, c, g, or t
  misc_feature (258)..(260): n is a, c, g, or t
  misc_feature (292)..(292): n is a, c, g, or t
  misc_feature (327)..(327): n is a, c, g, or t
  unsure (1)..(328): unsure at all n locations
acaagtcatttcaacttttcgaatanaatttctcgtaagatggattttgttttctcgatttgtaagatggcttgaaaggacgtggattccttcgtagttggacacaacgtggactcctttctgttggatatgaatgttaatccatcagcaggtctnnnnagtgctaatcctaatctccttgnaattacaattaatattccntttgtatatagnatgagtttacagancggtgtgcaangtgttttccatctaagaagnnncagggagtctcagtccaagaaagagaagaatnacacggtactggtaatgcacttattagcacctgana

SEQ ID NO: 1202 - DNA, 597 bp, Zea mays
  misc_feature (212)..(212): n is a, c, g, or t
  misc_feature (501)..(501): n is a, c, g, or t
  misc_feature (503)..(503): n is a, c, g, or t
  misc_feature (507)..(507): n is a, c, g, or t
  misc_feature (519)..(520): n is a, c, g, or t
  misc_feature (522)..(522): n is a, c, g, or t
  misc_feature (526)..(526): n is a, c, g, or t
  misc_feature (535)..(537): n is a, c, g, or t
  misc_feature (544)..(544): n is a, c, g, or t
  misc_feature (546)..(547): n is a, c, g, or t
  misc_feature (549)..(555): n is a, c, g, or t
  misc_feature (568)..(569): n is a, c, g, or t
  misc_feature (576)..(580): n is a, c, g, or t
  misc_feature (584)..(584): n is a, c, g, or t
  misc_feature (586)..(593): n is a, c, g, or t
  unsure (1)..(597): unsure at all n locations
caatgctttcgtatattatcctctcttctcattatttcatatgcacttgcaaaagtggcaaacaatcataatatcatcgctcattaaaaaaacagaaaaactattgcttgtaccatcacatggaaacaatttcaaccaaacatatatcgaggcgttaacagacaaactgattcaaaagaactcaggttggctagtgttctcattgtctcatntacactacaaaattaatagaaatatcaatcaatcatagtgccatcagcttgccaaatcgctgagggtctacagtcataggacagacaatttaaattaggtttctattgaggtataaaattcatcaactaattcagagggagctcatgcacttggagattgaagaacacaccaaagttgccttacaattaggctggtccaaacacagaatttaaatatttcataatcaagtctatccaaccgaagggcaggtctggtgcaggggtgagagttgtctcactgagtcaccangncgcnggtttgcagcanncnctcngtatttacnnngggaagncnngnnnnnnnttatcccttcccnnaaccccnnnnntgtngnnnnnnnnaaca

SEQ ID NO: 1203 - DNA, 540 bp, Zea mays
  misc_feature (485)..(485): n is a, c, g, or t
  misc_feature (501)..(505): n is a, c, g, or t
  misc_feature (510)..(535): n is a, c, g, or t
  misc_feature (539)..(539): n is a, c, g, or t
  unsure (1)..(540): unsure at all n locations
cctgcagctcggtgtcggcctgcaccgactcgtccgacgggtagtacgtggccacgtaggcgccgcaccaccgcgtgatggccgaccagaggagcagcccgtcggtggcgtacgggtagtcctcgatgagcagccgcagaccgtgcggcttcgtcgggtcctccacggccattcctctgtgacaagggaacacacaccatgtcagcctgcggctcgtacttccgattttaatttccattccaggtgtttttgtgtaccttctgatgagatcggcggggaggccctcctggtcgagccgccagagctcccggtacgcgaacgagctcatctccatgcagtagcggccaggggtgaacccggactcgatgacgccgtcgccgttgatgaggatctgccgcgccagcgcgttgatcttgagcgtgtagcgcatgtgcggcttcagcagcttgaagatggggtgcatcgcgctcagctgccggtgcgcngcgatgatgaacggcnnnnngcacnnnnnnnnnnnnnnnnnnnnnnnnnntgcng

SEQ ID NO: 1204 - DNA, 610 bp, Zea mays
  misc_feature (145)..(145): n is a, c, g, or t
  misc_feature (481)..(490): n is a, c, g, or t
  misc_feature (492)..(506): n is a, c, g, or t
  misc_feature (508)..(508): n is a, c, g, or t
  misc_feature (511)..(515): n is a, c, g, or t
  misc_feature (521)..(521): n is a, c, g, or t
  misc_feature (523)..(525): n is a, c, g, or t
  misc_feature (530)..(543): n is a, c, g, or t
  misc_feature (556)..(568): n is a, c, g, or t
  misc_feature (580)..(586): n is a, c, g, or t
  misc_feature (595)..(603): n is a, c, g, or t
  unsure (1)..(610): unsure at all n locations
tgcagagagtaattaagatacttttgacggcaaacatgctgtagctttaagggagaaagaaaggggaaaaaatctaaagcaacctatgtggaaatcctcatgaaagtcaaacacatctcatgcaggttcactgatctcagcatgnttttgacccatcacgaaactctcatcccccacaaacttcgacagcgacgaccggcaagttaaatggagttctggtcatttgagctactgagaaatcatcaccccagattctgtgagtagtacactggcgggtggttcatgtaaccagttcgggactggacgaagaacggattcggcatgtaaggattggttactcccgtttggctttcttgacttgatggactgacaccagccaatgcgccaaagtttgcgtacacaggcatggatccagcagccctctcccttggcaagattgggatttgcggtggaaggcagtaaaatggacgtggtggcgtannnnnnnnnntnnnnnnnnnnnnnnntngannnnngggganannnatgcnnnnnnnnnnnnnngttctactacgcnnnnnnnnnnnnntgatcacaatcnnnnnnntcatcatgnnnnnnnnntgatgca

SEQ ID NO: 1205 - DNA, 655 bp, Zea mays
attcgagctcggtacccctggttcctctcctccgcccactgctgcgcgtgctgctgccttctctcgtgcagcctagtagcaccttcagaaccgggaaatgaaaaggagctttcaggactcggtcgtcactgactgaacagtagtgaaggttcagacggaagatgaaacgagaaaagactaacgatgtagcaggctagcagcagcagctttgcagcaaatgtacgtatacgactcaccagctccctcttgttgatgcagcgatgaaccgaagactaagactaccaggagcacgaaggcgaccagcctcgcaatcccaagtgacaccatgcttctgccgctagctgctgctgattcttcttctctatctcacctcacctgcgttcgttctcaccacactcccacacctacccctccttgcatctgcgagcgtgtgcgtgcatatatagaggcaaccggcaaggctcgtcaaaggcagctcgcaagtcaaaagacacaggagatttggctctaggcggcggcactgcagggttccgagttttaataccgtactacctccgtcctgtccccctcctcggccggcctcggccatcggacgagggaccgcatcccatgagaagaatctatggtctctggagctcgcgccttttgtttaata

SEQ ID NO: 1206 - DNA, 710 bp, Zea mays
  misc_feature (1)..(8): n is a, c, g, or t
  misc_feature (141)..(141): n is a, c, g, or t
  misc_feature (143)..(143): n is a, c, g, or t
  misc_feature (175)..(175): n is a, c, g, or t
  misc_feature (517)..(517): n is a, c, g, or t
  misc_feature (522)..(524): n is a, c, g, or t
  misc_feature (543)..(545): n is a, c, g, or t
  misc_feature (561)..(562): n is a, c, g, or t
  misc_feature (578)..(589): n is a, c, g, or t
  misc_feature (603)..(603): n is a, c, g, or t
  misc_feature (609)..(615): n is a, c, g, or t
  misc_feature (617)..(620): n is a, c, g, or t
  misc_feature (622)..(625): n is a, c, g, or t
  misc_feature (628)..(629): n is a, c, g, or t
  misc_feature (631)..(631): n is a, c, g, or t
  misc_feature (635)..(635): n is a, c, g, or t
  misc_feature (637)..(637): n is a, c, g, or t
  misc_feature (639)..(645): n is a, c, g, or t
  misc_feature (647)..(647): n is a, c, g, or t
  misc_feature (652)..(654): n is a, c, g, or t
  misc_feature (656)..(656): n is a, c, g, or t
  misc_feature (665)..(676): n is a, c, g, or t
  misc_feature (678)..(682): n is a, c, g, or t
  misc_feature (686)..(687): n is a, c, g, or t
  misc_feature (696)..(706): n is a, c, g, or t
  unsure (1)..(710): unsure at all n locations
nnnnnnnnttgttttcagcaatgaagaattcaccataaggatcgtcaataactccctcatacacccacctaacatggccgaaaacaaattcacataatagcatgagcactaggactctaaacaagacatgacaataattanangatgtgtgttgagtattgacttcagcttaaangtgaaagctagcaaagacaaacaaggaaagaagctatggacaatcatgaacctttctagcatcctgaggtatgctgcacttgcatattctgtcatcttctccagtaaagaccgaacaacactatcaccacccatcgcctttgcctgagttgaaggatatgatagatgcattacatgtttaaataagtataatgtgaattcgggaaaactaagctctgagaaaaatgtgaagtaagaaaccaatccaattgaagaaaatcgttttatctataagaaaattaaaaactggactgctatatttatcttatatttacagtaagcagacaggaggagggaggaggcncagannnaacagtgtgtaatctcagnnncataaactcatttganngagtacctggctttgnnnnnnnnnnnntgtcgctgaaccantagtannnnnnnannnngnnnnctnnantagnantnnnnnnncnttcannnanctcatcatnnnnnnnnnnnnannnnncatnncttttaatnnnnnnnnnnntaat

SEQ ID NO: 1207 - DNA, 466 bp, Zea mays
ccctgaacattaaaactaaaacatccttttagtcttgtgtccaccgaaatcaattgagggtttgaggtaatgcatcagtcattgtctattgatcagcacaaaaagtaaggatgagctattatacccagaaaccttcaaattaagataaattgatattcccatagtaagcagttaagcgcaccctttgaccagtagttaaacaccagccactgacacaaagccagcaaaggagcacaaaataaccatacacgtgttgtaatactgatttaggtctcttttggttgagcttttttaacctgctttggtttttataaaagccaaatgttaatcaaaggtaggcttccacagaggcggaccactggtgtaagtactaacttttgaacttggcagttaaggatcgagtcttgatgatctttgttttttgtttctttttttgatatttttcctggcacactctaagtgtagc

SEQ ID NO: 1208 - DNA, 724 bp, Zea mays
  misc_feature (336)..(463): n is a, c, g, or t
  misc_feature (493)..(625): n is a, c, g, or t
  misc_feature (710)..(722): n is a, c, g, or t
  unsure (1)..(724): unsure at all n locations
ctgatggcaggttacacctgtttgaagtgccacatattcgtgtctagctggtttcaagctagtggacaagacacatgaagtatctgaactattacaggtagcagcttgctagtaggctgcctgaaatatgttcatatcaacacatttcatgcaatcagttgagatgatacatggtgacgttgaccaattctgcataaatgaatccacttggagcaaccgaggcataatagtttatcctccatttctttcaccttggaattgggactgattccgagctgatggtagactgctggttttattgtgtacttagagtagctgtttagaagtgatctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggaaataaataagtggagacacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggaatgtcctcaagatttattgtttggttttgttagattagcttggtagagaactacatctgctaaagtatagtttgagannnnnnnnnnnnnaa

SEQ ID NO: 1209 - DNA, 931 bp, Zea mays
tcatcgtggctgctagctcaattggcgaggagctgttctaccgcgccgccatttcagggagcactggccgatattttcctgagaagcacggagctaatgaaggatgctcgagggattgcatcactgagtggtatcgttcctcctctggttccattcgctcagacgttcgcggcagtcatcactgcagccctcacaggaaccctctactacgtcgccacaactccgaaagaccctacgtatgtggtgacaccagcgatgcgttcgcgcacagggcgtgagaacctcaagaaactatttgcagcttggtacgagaggaggcaaatgaggaagatatactcgccgcttctggaaggaatcttggctttctaccttggcttcgaatggatccagaccgacaatatcctggcacctatgatcacccacggcatatactccaccgttgttcttggccatgggctctggaagatccacgaccaccggagaaggctacggcagcggattcagaaggtcaggagtgaagggagtagctctgcagacgacacattgtaactgcagcatgtagatcggcgtggtctactgctggatagctagctgctgattgcacgcgcgtactgggtgatcgatcgatctaccgatcagtcagaagaccagaggcgtacgtctcacaagttttgatctacttaatatcaacaagataggtataagattgggcaaaaaatatatgtaatgcatgtagtcatgtaacgtagatacaatgtgtacatatatggataaatatatgcaggctgtaatcaatataggaagtatataccgcgtgattggtagactgcatgaccactcccgtggatacgtaaagttgtatttgtttggttcgcttctttagccatccaagtatgttataaattaccctcctagtttcaagtaccccccc

SEQ ID NO: 1210 - DNA, 658 bp, Zea mays
  misc_feature (66)..(66): n is a, c, g, or t
  misc_feature (78)..(78): n is a, c, g, or t
  misc_feature (243)..(243): n is a, c, g, or t
  misc_feature (269)..(269): n is a, c, g, or t
  misc_feature (277)..(277): n is a, c, g, or t
  misc_feature (308)..(308): n is a, c, g, or t
  misc_feature (327)..(327): n is a, c, g, or t
  misc_feature (459)..(464): n is a, c, g, or t
  misc_feature (554)..(556): n is a, c, g, or t
  misc_feature (573)..(574): n is a, c, g, or t
  misc_feature (582)..(583): n is a, c, g, or t
  misc_feature (598)..(598): n is a, c, g, or t
  misc_feature (608)..(608): n is a, c, g, or t
  misc_feature (610)..(613): n is a, c, g, or t
  misc_feature (617)..(620): n is a, c, g, or t
  misc_feature (622)..(629): n is a, c, g, or t
  misc_feature (634)..(636): n is a, c, g, or t
  misc_feature (645)..(646): n is a, c, g, or t
  misc_feature (652)..(654): n is a, c, g, or t
  unsure (1)..(658): unsure at all n locations
aacggttacaggccaaattgcaacatccaggatcagtgtaagccagcaatgccgtggcgtcaaatncaaatcgaattncttaacctctcccaagaacggccaaagcctatttctgtgacactggcaacgagtgtagcaacagtcacactggcaagcaagcaagcagcaccagcgtttactcaaagtcgcaaaccaacgaaatgccatggcgaagctattgtggaagctggcgtacgtcgagcnccagcgctacgcccagcgtcggctcntcgtgtgncaagtctggacattgtgtaatttggaggatngcagaaaaataaataactngtggagtttggacaaatccagccggtccttatcagttagttcaggctatacaaagacgacaatgcacacgtcgccaccaatcttgttttacttggctttgtccactgcacttctgctgcggtatatatatannnnnnagccgctctgctagcagaagcaaaacatgcatcgggaacccttacaggtagataccacaaccctgtgcagagttcttgcagtctcatcannntgacaggaacgacatannacatggannccaccctgagcccgnagccccattncnnnntcannnnannnnnnnncaccnnncacatgatnnccatcnnngaca

SEQ ID NO: 1211 - DNA, 618 bp, Zea mays
  misc_feature (511)..(511): n is a, c, g, or t
  misc_feature (582)..(583): n is a, c, g, or t
  misc_feature (597)..(598): n is a, c, g, or t
  misc_feature (602)..(613): n is a, c, g, or t
  unsure (1)..(618): unsure at all n locations
tgcctgcaggcagtgcctgggcagcgccgagaagccctccacgccgaggatggccatgttgcggtagatgagcgcgtagggggccttccagtacccgtccggctcgcccacgtcgaacgccctgtagaagagcatgaaggtgagcggcgccaggacgcaccccatcagcgtgcccacggcctgccccaccagcatcgaccgcggcgacgtcagcgtcaggtgccccgtcttgaagtcgtgcatcaggtcggccgacacgagcaccagctgcttcaccagcccgcaccccaccagcccggccaccacgccgctgtccttccccgcccacgccgccagcacgaacagcgcgaccttcccgtagttgtaccccatgttcatgtccgtcagcccggtcccgtacgcgttgcagaaccccagcgccggcgccagcgcgtacgccaccaccacgtagtaccacctcacctcccggaacatgatcgggatggcgatcaccgcgatcaggctcagcgcngcgtaccccgcgtaggacagccacgtcgggatgttgtccctgttgaacacctcgtcgcgctgcatgtcgtnnagcgccatcgtgtnngcgnnnnnnnnnnnncagta

SEQ ID NO: 1212 - DNA, 640 bp, Zea mays
  misc_feature (15)..(15): n is a, c, g, or t
  misc_feature (32)..(32): n is a, c, g, or t
  misc_feature (94)..(94): n is a, c, g, or t
  misc_feature (131)..(131): n is a, c, g, or t
  misc_feature (160)..(160): n is a, c, g, or t
  misc_feature (171)..(171): n is a, c, g, or t
  misc_feature (264)..(264): n is a, c, g, or t
  misc_feature (280)..(282): n is a, c, g, or t
  misc_feature (350)..(350): n is a, c, g, or t
  misc_feature (500)..(504): n is a, c, g, or t
  misc_feature (513)..(514): n is a, c, g, or t
  misc_feature (537)..(537): n is a, c, g, or t
  misc_feature (539)..(548): n is a, c, g, or t
  misc_feature (551)..(554): n is a, c, g, or t
  misc_feature (569)..(574): n is a, c, g, or t
  misc_feature (577)..(582): n is a, c, g, or t
  misc_feature (584)..(624): n is a, c, g, or t
  misc_feature (627)..(627): n is a, c, g, or t
  misc_feature (629)..(633): n is a, c, g, or t
  unsure (1)..(640): unsure at all n locations
ctcggacggaggaanctccagtcgacagcaangactactggggcgcgcactcacttccacggccactgggtctcggactcaccgtgaagccacngcaatctgatggacatggactaggttaacatctcctnagcctgaaacgtgacagctgacatgggtnagagtgaaaanaaaattagtttaggcattaggggacacgacgcagaacggggtggctcgaggccaagcgggcggcggacccgagcggataaggacgagctcggncctcaactgtcgctgnnntggcgcatgacacaaacacaaagcatcgtttcctgttggtaatttaccaccactagcgctagcctacnactggtatgttttttgtttttgtttttttttgcattggatcgtagaattataaactttataatatgccataaaagctgaaggttgcagtattagtttaaattattctatttgttaatttaaaacgttgtcgcaggctcgcagctgctgtnnnnntctgctttnncctcccccggtctacaaagaccncnnnnnnnnnntcnnnnatgctcttcttcctnnnnnngcnnnnnnannnnnnnnnnnnnnnnnnnnnnnnnnnnnnnnnnnnnnnnnccntnnnnnctacata

SEQ ID NO: 1213 - DNA, 507 bp, Zea mays
  misc_feature (10)..(10): n is a, c, g, or t
  misc_feature (340)..(340): n is a, c, g, or t
  misc_feature (421)..(421): n is a, c, g, or t
  misc_feature (506)..(506): n is a, c, g, or t
  unsure (1)..(507): unsure at all n locations
cgtcaacaangtagccaccttctcatcatcgtcctcagcccaaggcgcagcctccaagtactccaagcaagacaacaccccggcatcgaatacaatggctgcggacacctggagaaggaacagataaataaatcagtgtgcaaaaaatgggaaatcgttccgcagaatcggcatacatgagacggtagaaggccgcgataccttcaggatgccaaggaccttgttcacatcctcccgcatcagcctccggcggagatccttgcagtacatgagccgcagcgtctcggcgtacacctcgacgtcgtcgcagtcggagatctcgacgatgtgcggcagcgtncgctgctgcttggaccagcggtcggacagtttggcggcgaagaacctgctgtgcgcgacgagtatgtggcggtgaacgcanagcgtgacggagaggccgtccttggagctgagggtgaggcggacgtcggaggagtcggcgtcgttgaactggttcccggggctana

SEQ ID NO: 1214 - DNA, 631 bp, Zea mays
  misc_feature (70)..(70): n is a, c, g, or t
  misc_feature (113)..(113): n is a, c, g, or t
  misc_feature (151)..(151): n is a, c, g, or t
  misc_feature (311)..(311): n is a, c, g, or t
  misc_feature (448)..(448): n is a, c, g, or t
  misc_feature (497)..(497): n is a, c, g, or t
  misc_feature (550)..(551): n is a, c, g, or t
  misc_feature (556)..(560): n is a, c, g, or t
  misc_feature (568)..(569): n is a, c, g, or t
  misc_feature (603)..(610): n is a, c, g, or t
  misc_feature (612)..(630): n is a, c, g, or t
  unsure (1)..(631): unsure at all n locations
ctgggatttgtgcgttgtctactgttaggcagtctcggaaagcaaactgaggcagctgataatctgaaanacggccagctaaagcagtagcttcagcctcaagtgaactatgnccggtaggtgtaggtggatgtgcaacatcacctagcanttgttcgatgacaggtatgaaaggcgagcctctctccccagttggcaatgaatgcctattggccaattccatagcaggctctgggtccttttcgcttgaatttggaaggttttctgccagtagaacactgttgtcccaccaatcttgcacaaagctgttngtgctaagatcaagcatcatagtttccagcagactgttgtttccactacagtccttcatgttgttttctagagtttcagcagtagcttcttcaggtgatctgttaggtaattcaggaaatgtactgttaccctggcntgtaaagtcggcagtatccttgaattgacttgagtcaccttgaacaatnaaggattcttcttgtgagaggagcctcacagattctccagggtcaggtatcanngattnnnnntgcatganngcatggtatggtgataggcgattttcttggaatnnnnnnnnannnnnnnnnnnnnnnnnnna

SEQ ID NO: 1215 - DNA, 255 bp, Zea mays
taccgttaccgtcaagggcttgtctaatcaaggaatgagttggtaatcgatgcaggattaatgggaacaggaggagcaacgtatgattactcttccactatggccattggacagcgagacagatccctgtggcaaggtcagtgctgaaagcccggagccggtcatgccagttcttggcaccttgctctgctcagtgctcgtccccttttcagtgctcttcaatgtcaaagctcagaaagctgtgtgggcttgggt

SEQ ID NO: 1216 - DNA, 697 bp, Zea mays
  misc_feature (413)..(413): n is a, c, g, or t
  misc_feature (594)..(595): n is a, c, g, or t
  misc_feature (610)..(615): n is a, c, g, or t
  misc_feature (626)..(626): n is a, c, g, or t
  misc_feature (628)..(629): n is a, c, g, or t
  misc_feature (631)..(632): n is a, c, g, or t
  misc_feature (636)..(639): n is a, c, g, or t
  misc_feature (641)..(641): n is a, c, g, or t
  misc_feature (652)..(653): n is a, c, g, or t
  misc_feature (659)..(659): n is a, c, g, or t
  misc_feature (675)..(681): n is a, c, g, or t
  misc_feature (683)..(691): n is a, c, g, or t
  misc_feature (693)..(693): n is a, c, g, or t
  unsure (1)..(697): unsure at all n locations
gaacatcatcactgacgtctgatacagcaaaatgcagcagctggtggatggctttgttgtttgcagttcccctataggctagagccaatgcatacataccaccataacgtaatatgggatcttgatctctagtcatttgttcaatcaaggtgtctgcttcctcttccctgccatatactgtcaatgcaattcccagtgacaaacccctgaaagagaaagagaactgtcagagtgtagttcttcagatcaagtacataagcactgtagaacaatcaaacagcaccaaccttataatcttttcatgctgtgtatcatgtgcataagcaagcatctcactagccttctcactggcggtcccaaccatgagcaagcccatgccaataccagctgcctcaccagcaacagcactgtcngtgtaaaggacattctttatgtcctcatatatttcctcatctgcggttcccaaagctgcaagcccaagccccaaacatgcaccatgctggatgacctgtatgacattgggggttggagttagcataatatgcatgaaatgaataacaaaataaaagacagaaaataaacaataatcacctnngcactggagttgcgnnnnnnttcacggaggnanngnntgannnntncaccatgattnncatgantcaaacctagtgcgtnnnnnnnannnnnnnnngnatat

SEQ ID NO: 1217 - DNA, 1049 bp, Zea mays
  misc_feature (387)..(387): n is a, c, g, or t
  misc_feature (964)..(964): n is a, c, g, or t
  misc_feature (980)..(982): n is a, c, g, or t
  misc_feature (1031)..(1042): n is a, c, g, or t
  unsure (1)..(1049): unsure at all n locations
ggaaagagagatcagttttgctacgtccaatccaataattatgaagaaaagatagattggtactctggaactgctgtagtaaaaccgaaaaggactgatgtgtgatgaaactgtgatgcatacatcaacagaaagtacagatatgcactacactggtttacttccattgttgcaataagaacaagattcggtttgcttacaacatctttgaataaaaaaataaataagttgcagtacacacaagaaaaaaacatcaaatgggaaatacataccagtactcatgttctggttctggaccttaatgccacctgatgcagaaagaactacagaaaccacaaaaccaaaggtcacacatcctaaaacccatcagatttagtaaaaaaaaantatgtgatgtctagcatcgtaaaaaaaaagagacgatgagtaccagatatagcgggcgtaaggattccatctccaattgctgtacaagtaccaattaaaacaagaataagaagaatgtttctcttatatgcatgtgactctatccatctctttattttcgctgcaactgaattctcttcataggtttgccgactatacgtcgtcaattcctcgtcggtcctgtgttgattaggtatggtgttgatctttgcgtgacggcataatagggaataaagagcaaatgtaccacctgccagaaagtgcaacatgttgccaccttagaagtcacgtattatgcaaacactgagaagcagcaaaaatttatctcaggtcaaaagtttaatcattattaaaaaaatgctcttcagcaccctgacatctctcaagaaaggaaaagtattcttattacaaattcaagaggtgtgatatgtcaaaagtgtgatgtgctatcatacttcccaagtacagtaaaatctctatttttctattgtatacaaatttagttatttgagaagtattgctggtggtaattcacctnctaaggcatgcagacnnntaaggggttggtaagacatttcgtttaaataaaaacatggttgcacatnnnnnnnnnnnngcaggca

SEQ ID NO: 1218 - DNA, 530 bp, Zea mays
  misc_feature (24)..(24): n is a, c, g, or t
  misc_feature (32)..(32): n is a, c, g, or t
  misc_feature (40)..(41): n is a, c, g, or t
  misc_feature (46)..(46): n is a, c, g, or t
  misc_feature (55)..(55): n is a, c, g, or t
  misc_feature (60)..(60): n is a, c, g, or t
  misc_feature (72)..(77): n is a, c, g, or t
  misc_feature (83)..(83): n is a, c, g, or t
  misc_feature (85)..(85): n is a, c, g, or t
  misc_feature (264)..(264): n is a, c, g, or t
  misc_feature (403)..(403): n is a, c, g, or t
  misc_feature (421)..(421): n is a, c, g, or t
  misc_feature (434)..(435): n is a, c, g, or t
  misc_feature (465)..(465): n is a, c, g, or t
  misc_feature (515)..(516): n is a, c, g, or t
  misc_feature (521)..(529): n is a, c, g, or t
  unsure (1)..(530): unsure at all n locations
tgatgatgatgataaggaggatgncttcgtcntcgctggnngcaancggccggtncgagnggagcgtgacannnnnncgctananccagatcccctgccgacgccagcggagaccaatcggttcaagcggctgcggaagggctctgcgacagcccatccggcgcaaactccccaggtgccgcaccgtgaggcgcctgacgctccgtcttcctcccttagcatcagcgacgacgacttcctaactggcggccagcatcacgagcnactgaagccacaagcctctcctcggatcccctcatcgctcagtatcgaagacgaggacgacgacttcttcctcgctggtgaccgacagccagagccaacactgcctcaagtgactcaactcaagcggctgcggaagggncctgtcccgccacatctngcgccatcaccgnntcctcccaaggtgccaggacagcccacganggaagcccctccagtaatgactgaagatgcagcacgaggggcggttgggnnttggnnnnnnnnna

SEQ ID NO: 1219 - DNA, 744 bp, Zea mays
ttgcttgctgtacgagtactagcatgattccccccaccgccccacctttaatcatagcacatctctgaagcctgaagcagaactccggctcgcacgaatcatcagacggggactggtcgatcgacgatcagcgcagagctagctagctgcattgacataattgtcttgtgtgctgccttgttttctgcaggtccttagtgctccatacttgaagaacaacggccatcaagtgccctacctgaaggtaggtgccgtgccgtgccagtagtcagtaccagtcactgtgcatgcatgctctccttttcattttgatggatcatggtagtcgttcgtactacctgctgctgaactgaatgaactgttcaaagctgatgccggctttatatgcgtgcgtttcgtttcagagatcaagtcctgacaggtccgaggacgacaacagccatgccggcgagagatcactcaagggccgggggctgtgcctggtcccgatatcgagcacgttcgcggtagccagcgaggtgcccgtcgatttcgggtggagtactgcatttgctgccagctttaggtagaagagaaggctgggaacgaagagcgcgccaaagctctgatcagaggcgtcgaacgagtatataactagctagctagccagctaccacagatcgatcgacctgccctgctgacgatattatatgcatatgtcgatgcgtttctgatctagtgagtctagcagtgtatggttatgcg

SEQ ID NO: 1220 - DNA, 560 bp, Zea mays
ctgacatgcttattgcctggggccacaagatcgaaaaccgctcagtacagttcccagacaaaaggccaattagctttacagtgtgatctcatcttttaaccccaccaaatttatctccatgcaaaattcaagaacttacattacatccaccactcaaactactgccaactacattacaatctctctcaactgtgtaatgagcctaaggaacagatggattacggtaaaatggcgcactgcattttcatgtgcaaggaaaactggcacatgcgaaagaaaaatgttgcacagaaaaacactggaaacgaaccaacagatgtaggcctcccgaggccttcgaaggcttgaagctatctcattgatgtgttgttccggttcacgtcaaataattagccccacttgacaatagctgaaccccaggtaagtccagcaccaaaacctgacgccgcaataatatcgccagccttcaccttgccactgcgaacagcctcatccaaagctaacgggatggatgccgcgctggtattgccatagttggcaagatttgaaataaccttgtc

SEQ ID NO: 1221 - DNA, 311 bp, Zea mays
  misc_feature (4)..(4): n is a, c, g, or t
  misc_feature (39)..(45): n is a, c, g, or t
  misc_feature (134)..(134): n is a, c, g, or t
  unsure (1)..(311): unsure at all n locations
tttnaggactctcttatagtcttatttcaagttgactannnnnnntacagagaaagaggcatacctgttggaccagtgtatactgcaagctgcctgtacaacaaccattgggatcaaagctcaattgcatatcncaatcgctcagctaaaggcattggaaaaacaagtagaaagtctagcagcttactcagttgcatatcccaatcgctcagctaaaggcataattcctagcatgctgaaaagaaaaaccaatccctgcaattttaatgtcacgtgaaccatgtcagcattaagttaacaggggggggggg

SEQ ID NO: 1222 - DNA, 571 bp, Zea mays
  misc_feature (4)..(6): n is a, c, g, or t
  misc_feature (22)..(24): n is a, c, g, or t
  misc_feature (28)..(36): n is a, c, g, or t
  misc_feature (39)..(45): n is a, c, g, or t
  misc_feature (52)..(79): n is a, c, g, or t
  misc_feature (126)..(320): n is a, c, g, or t
  misc_feature (545)..(545): n is a, c, g, or t
  unsure (1)..(571): unsure at all n locations
gtcnnncccccccccctgtttnnncttnnnnnnnnnctnnnnnnnaggcttnnnnnnnnnnnnnnnnnnnnnnnnnnnntttttcttttctgccctctgggtgttgtatttcggtccactttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttagcaggacaagtcttaacgtcagacaaaaatacactgtactgagtaagaaaaaataattgtttcggggtgatctcttttaggacagttaacagttaagttaattagcaataagccatccaacatactgtctatttcaaatgcaagtatcataaaattcaactggaaacttatcatgccatcaaccaacaggggcattcttttgcataagaattgcaaganccatattacaaaattcagatttaaag

SEQ ID NO: 1223 - DNA, 546 bp, Zea mays
  misc_feature (28)..(28): n is a, c, g, or t
  misc_feature (99)..(103): n is a, c, g, or t
  misc_feature (108)..(108): n is a, c, g, or t
  misc_feature (158)..(158): n is a, c, g, or t
  misc_feature (163)..(163): n is a, c, g, or t
  misc_feature (203)..(206): n is a, c, g, or t
  misc_feature (276)..(276): n is a, c, g, or t
  misc_feature (299)..(299): n is a, c, g, or t
  misc_feature (353)..(353): n is a, c, g, or t
  misc_feature (388)..(389): n is a, c, g, or t
  misc_feature (436)..(436): n is a, c, g, or t
  misc_feature (501)..(501): n is a, c, g, or t
  misc_feature (510)..(510): n is a, c, g, or t
  misc_feature (512)..(512): n is a, c, g, or t
  unsure (1)..(546): unsure at all n locations
caacaaaagaaaagtgttagaatataangattaacacatgtccaccaaactgtcagaacgaaaggctaaaacagcacacgatattgcaaggcaataaannnnncaggnggtagatgttaacgtgtaaatataaatccaagcaaacgagcaagtgtctngatangttctttgctcaattgtgacctagttgtatccccttaatnnnncccttatctatcatttcaccagttgcctttgtctggatgtatcactaaacatcattattcaattgcagancagaaaataaatctactacaagnttgagattcattcaatggaagactaagaatgtaaaaaaaagagcatacataggncctgtttggaatagctctagctccaagaccaatannggatttggagtttgtagtatgaaataaacgggtataaacatttgttnaatatgcccccaactccagccccaagaatttatagagctacagatgaccagctcaaaaaaatctnggagagctntnccatgccaacatcagaaacaaaaactgtaatgcc

SEQ ID NO: 1224 - DNA, 614 bp, Zea mays
  misc_feature (79)..(79): n is a, c, g, or t
  misc_feature (266)..(266): n is a, c, g, or t
  misc_feature (325)..(325): n is a, c, g, or t
  misc_feature (354)..(354): n is a, c, g, or t
  misc_feature (395)..(395): n is a, c, g, or t
  misc_feature (446)..(446): n is a, c, g, or t
  misc_feature (475)..(477): n is a, c, g, or t
  misc_feature (541)..(541): n is a, c, g, or t
  misc_feature (543)..(543): n is a, c, g, or t
  unsure (1)..(614): unsure at all n locations
cacgtggttcctgtgacgaccgcctcaagtcaagtgggatgggagctccaacgttttccatttgccacacagctagtgnaggcgagtttggcgtgtgtgctatgccgatgccagtgcgtactgcgtagcctagtcccgtccatcacattgcagtttcaattgtcaatggaacacatatatctgcgtagtttccttcactgatctctatcggtgcatcatcaaaactcaaagtcagagtaatctccactacaaatctcgagaacaantgacaatctgacaagaaatctaacgtacgaataactatttccttcttggcacggctgtnactattacgtactattctttttttattanttgaaatggtgtacaagtgacatggtacaacacaagagaancccaaaaaaaaaactttcggtgttttcttgtgacatcctcggtacagtcanccaggtgacagatttgcagtcaagaagannnggcgatgagctacggacattttcagtggtaatcatattagaccagaagatccgcaaaaaaaaantngccattgctggacagtaatagtacacattttttttccttcctttgctaagtcatacgattcaaaccgcaga

SEQ ID NO: 1225 - DNA, 562 bp, Zea mays
  misc_feature (224)..(224): n is a, c, g, or t
  misc_feature (340)..(340): n is a, c, g, or t
  misc_feature (372)..(372): n is a, c, g, or t
  misc_feature (374)..(374): n is a, c, g, or t
  misc_feature (399)..(399): n is a, c, g, or t
  misc_feature (439)..(439): n is a, c, g, or t
  misc_feature (449)..(449): n is a, c, g, or t
  misc_feature (464)..(464): n is a, c, g, or t
  misc_feature (503)..(503): n is a, c, g, or t
  misc_feature (534)..(534): n is a, c, g, or t
  unsure (1)..(562): unsure at all n locations
aaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagtcacaggcgtcaagctctgtatccgngaccacgagtctagccccaacctgaagaacattgagctggaaggcaattttgaccagatcaagcaagccggcgaaatggtgagggacctcatcgcgaccatcagcacgagcatgcnggcgaaaaactcatctgctgccgtggctccancnggaggccgaggcggtggtctgggtngcaagagcaactacaagacgaagctatgcgagaacttcgngaagggtgcntgtactttcggcgancggtgccactttgcccatggcgagaacgagcagcggagnggtgctgtttgagagttgaggtgccaactcnaggcatgacatgtcctgtgctctccatt

SEQ ID NO: 1226 - DNA, 467 bp, Zea mays
  misc_feature (28)..(38): n is a, c, g, or t
  misc_feature (378)..(391): n is a, c, g, or t
  misc_feature (403)..(406): n is a, c, g, or t
  misc_feature (409)..(410): n is a, c, g, or t
  misc_feature (417)..(417): n is a, c, g, or t
  misc_feature (419)..(424): n is a, c, g, or t
  misc_feature (430)..(441): n is a, c, g, or t
  misc_feature (449)..(462): n is a, c, g, or t
  misc_feature (466)..(466): n is a, c, g, or t
  unsure (1)..(467): unsure at all n locations
ttccattagtaaattattattcagtttnnnnnnnnnnngcgaattacgcacaaaaacaaaaatcacaggcagtaatgtgttgtttgaattcatacctggttgatgaaaagatctctgaaaacacccgagcaattgacgacgacatcgatcctcgggcgtccaagctcctcaaggctgacaggctccacacggttgacacggccgaaggtgtcggcaactggccgaactccaatcatccacagcacctgggctagtgactcaccataggtcttgatgttatcggtgccccacaggacaagtgcgaccgtctcagggtacttgccgccattgtcagccttctgcctctccaggagacggtccacgacgatcttggcgctnnnnnnnnnnnnnntggttgggatgnnnngcnnatcgagngnnnnnntgttcnnnnnnnnnnnnagcacctnnnnnnnnnnnnnngggnc

SEQ ID NO: 1227 - DNA, 703 bp, Zea mays
  misc_feature (375)..(375): n is a, c, g, or t
  misc_feature (682)..(682): n is a, c, g, or t
  unsure (1)..(703): unsure at all n locations
ctcctcaaagcatttcaacgctctatctggcagtgacactctagcccaacctttaatcaacgtggtaaacgtcttgacatttggtttcaatccaacatctgccatttcttgaatcacattttccgctctctacaataaatagttcaaacaagaaattagtgaataatgtgcaacaaaggccaggattacttctccattcacattttcccgatgacaataagctaagatgaagccatgtaggcacattgtgtgaataaagggcattgcagacattgtgttcagccaccttcaaaaactccaataatgtccaactgtaacaccacaaactactaatcaaatattttgatgcaaaatgcacacacctgcatgtctccngctttgcagcatgcatttatgtaggaagtaaatgtatggatgttaggagggattccatcctctttcatttgtttcaacaaatctgctgcctcccagacatctcctctccgagcccaactacatgaaagaatgtaatgacacagtattttagtctttagattatacaatactcttaacagggatttgacaaactatttttgattataacatggctcaagtaaatcataaattgacatgatatgaaagcaagtgtctgaattactgaggtaaataataataattttggtccttttctatagtatttcanaaatggacatcatatatggca

SEQ ID NO: 1228 - DNA, 1434 bp, Zea mays
  misc_feature (603)..(603): n is a, c, g, or t
  misc_feature (1404)..(1410): n is a, c, g, or t
  misc_feature (1428)..(1433): n is a, c, g, or t
  unsure (1)..(1434): unsure at all n locations
cgcaaatttattaattgttactactatcaggggggagaaaaaagatcacaaggcgagtgctttcacaacacaaattcgtttacttttttactaaaactggagactttatattatagtgaacttggcgtaaaaaaaagctaagtacagtacagtagtactgcacaagtgacaagaacttactgaatgtgccaaggtacaggtccttattgccagcgaccctcccaatcctggcctgccatctcccgtgctggtgatgcctgcaaacgtttgcatggggaacaagcagaggacaagaaaaggtttatactttatacacaagcagcaggcggatgcgtgtgcgtgcgtgtgagttcagaaaactcagaactcccaacagagagaggcacagagctgtgcccagactcggatgtgagatggctagaagttttggggtgttggaaaaggcagcaggtggggtgcaaaaatgggcgagcagacttgcagcacggcaccttgtcactcctctgtacatggatgctcccctcgagaagccgctgctgttcctgcaggaatataaatttggcagcaacaactttcgtaagcggccggcgttgccgcgttggncagatgtttttgatacagttttggatgcatgtgaacaaaaaaaagggggattcagaaacaacagtgcgcaggcagccagcttttgtttctagtgatgcctcagctcaggggcacagggctcttctgaaattggcacgtgaaagattccatgcatgcatgcatgcattcaaaccaaattctctctactactagtggtagcagcagtacgctgtaatgcaattgtgtttgttcccatgcacataaactcttagtgcagcatgcatgcggtgtaaataagaactgctatcatgcagtaccttctcaggtgtgcaatgaactcctgcctcgacatgtgcttcatctcctccagctccttctcgtagtggctcagctacgggcattatttagatcggaggccagtggatcaggaaacgtgtaccagccattcatcaaatgcaagaataaagagcgcatggacgatgaatagtgaagaacgaggcctgcgccggccccctacgttgagctacagggccctttttcttaatttcatgcatggagttagtagtaaattaaggtcgccgtgagaaggggacgaagggagccatcagtaaacgtaccgggaaatttatgtgagtcgaggggccccagtacttgagagctgccaggtcataagccctcgcagccttctcctccctgtcatagccgcctagagcagccacagtcatagcaaagacatggtggtgagcatgtggagcaacaaacagctaggaggaggcttgcagtagctcacctaggtagactgctcgtcgttgttgacattgnnnnnnnattgcaagaacaagaagnnnnnnt

SEQ ID NO: 1229 - DNA, 392 bp, Zea mays
gccacccgcaagcacccaaccagtcgagtctgctgccgctgctgtagacgttgattcggtcgagaaaggcccaggtacgacaccagagcaaccggcgaagcgaagggcacccaacgttcgacgaggacagagaagggtgctgcgaagcgcaacgagagaaggaagagcgacgtaggggggggatattgttgctgtatactaaatattaacggcccaaattaaagggggcaacacatgatccctagctaggttaactagagctatagcaatgactggccgtttccacgcgtacgagatgcgtagtgtgcatcatcaacctgtatccatgttgtattatcgtaggagtcgtaggccttacagtgaccacgcgtactggttagagttggtcgttc

SEQ ID NO: 1230 - DNA, 379 bp, Zea mays
ctaccaccactgggccagttaccaacactacaaaagctagttatgggaggaatggacagcactttgacagttgatgagggtttctgctgcgccggcccgggagcctttcctctattacaggaacttcaactatgccaaatggagaacctggaagtgtggaacacaacatactcctgtggccagagcaatgaggatgtgcaggaattcatgttcccaaaccttagggaactgttaattcgtgattgccccaagttgagactgaaaccatgcccacctaaaactgtgggatggaagatagagaacagcgacaatgtactgtcgtcatgggatgaggagggagatatcgaccttgcagcattgttcccatcaaggaaagagt

SEQ ID NO: 1231 - DNA, 553 bp, Zea mays
  misc_feature (39)..(39): n is a, c, g, or t
  misc_feature (42)..(42): n is a, c, g, or t
  misc_feature (228)..(228): n is a, c, g, or t
  misc_feature (417)..(417): n is a, c, g, or t
  unsure (1)..(553): unsure at all n locations
atgttattaaaccggctgagtattcctttaatctcctcnganccctcgcaccctggcatcatcaatgtccttggatgaggcagtaaggccccagaaacatcaccccaataatcagaatttgctacataccactccattgtcttttttaagccttcttcccatggggtgcgctcagcccatccaaggctcttgagcttctcatcgtccaagaaatacctctggtcattnaaaggtctgttctcgacaaacatgatgactttgtcaggttcaagattgaagagtctgcaaacatcttttgccacatcaagcactgtcctctccctttttgttccaatattataaacatgtccaacttctccatgatgaagaatgacctcaaatgcctccgcaacatcctcacaatagaggtagctacgnacattgactccatcaccatggatagggaggggctcccctctcatggccaagagaatgaactttgggataagcttctcagggaactgatttgggccatagacattgtttccccgagtagtgataactggcagtccat

SEQ ID NO: 1232 - DNA, 530 bp, Zea mays
  misc_feature (138)..(138): n is a, c, g, or t
  misc_feature (289)..(289): n is a, c, g, or t
  misc_feature (373)..(373): n is a, c, g, or t
  misc_feature (420)..(420): n is a, c, g, or t
  misc_feature (529)..(529): n is a, c, g, or t
  unsure (1)..(530): unsure at all n locations
ccttccttttattgtactgttagctggagttgctatctggtatgccaactgaaaattgtatcatcttttattgtataggatacagcttcagaaatctagatggtacacttaggtccctgttatttgttatgcaggtgntatctttctccttcaagtataatgaggaaccagccacatttgctcgtgattggaactggctttaattttggatatttggtggtaagtttcgttgctgttgttttttgttctcagattatttagctaattgtagctgctcaatgcaacaggntttttttatgtacaacaacactggcaagaacgaatccttttagtcccaaacaagatacagtagggagtaggccagtatcaatantaaacagagttttatatctaatcttaggtttgaaattttaatttgcngaagttccttttgatttaattttgtaaggctggtataattgaaaatagcagcttgagctagaaagcggaggctgcaagcctcctcacacattactgtagcaccagcagng

SEQ ID NO: 1233 - DNA, 615 bp, Zea mays
  misc_feature (1)..(1): n is a, c, g, or t
  misc_feature (343)..(345): n is a, c, g, or t
  misc_feature (455)..(455): n is a, c, g, or t
  unsure (1)..(615): unsure at all n locations
nggcagggctgcctgtccagctccaactggacgacctgccgacgttcttcgttgacaaggaccgtcccccgggacttctggagttgctgacgagccagttcttgggtttgggcaccgcggaccacgtgcttgtcaactcattctacgacttggagccgcaggtgagtaagcgaagcgcccacacacaaatgcacgtcggacatcatgtcatcctctgtgtatcactttcacaggaagcagattacttggcttccacttggggtgccaagacggtaggcccaaacatgccatcgacggtgtgcctcgacaaccacctctcggacgacgacggcaacgccgacgnnntagtatcctacggcgtccacctccacaccccgatgacggcagaatgcaaggcttggctggacgcccagccgccggtctccgtcgtgtacgtctccttcggcagcatagcntccctgggcgcgcgacagatggaggaagtagccgaggggctttgcggcagcggtatgccattcctgtgggtcgtccgggccacggagacccacaagctacccaagaacttctccctcgaggcgaaggcggcggggctcatcgtgccgtggtgcccgcagg

SEQ ID NO: 1234 - DNA, 473 bp, Zea mays
  misc_feature (265)..(265): n is a, c, g, or t
  unsure (1)..(473): unsure at all n locations
tctcatctcatgtcgagggagagaaaagaatgtgaaaggatttgcgtcgctatcagtgcactaattaccaggcgtagtctagagtcaagacagtagtttcgcgaagagcaacaacacagcaggtgcaagtgtaacgctacacttgattgctgttcttttttcatctctcctgcagacctgcactgtgctcttcctttcaagagtagcagcagcttcagttggtgctcttcaaccatgccggagctgagaaaggtgcgagggactncgcaggaagggtgacaccgccccctcgaagagaaaccgaggggcttttgctccagctagctttgctcatggcatgaacaccacgacgacagttatatcgtcgtggaaatgccttctcacaccacggtcgatcttcttgaggtctgaatatctcatctccctcttcttggcagcttcttgcatcgcggctttcactagtctccagccga

SEQ ID NO: 1235 - DNA, 692 bp, Zea mays
  misc_feature (49)..(49): n is a, c, g, or t
  misc_feature (72)..(72): n is a, c, g, or t
  misc_feature (248)..(248): n is a, c, g, or t
  misc_feature (276)..(277): n is a, c, g, or t
  misc_feature (347)..(347): n is a, c, g, or t
  misc_feature (352)..(352): n is a, c, g, or t
  misc_feature (378)..(378): n is a, c, g, or t
  misc_feature (412)..(412): n is a, c, g, or t
  misc_feature (418)..(419): n is a, c, g, or t
  misc_feature (459)..(459): n is a, c, g, or t
  misc_feature (480)..(480): n is a, c, g, or t
  misc_feature (489)..(489): n is a, c, g, or t
  misc_feature (556)..(556): n is a, c, g, or t
  misc_feature (558)..(558): n is a, c, g, or t
  misc_feature (563)..(563): n is a, c, g, or t
  misc_feature (598)..(599): n is a, c, g, or t
  misc_feature (616)..(616): n is a, c, g, or t
  misc_feature (618)..(618): n is a, c, g, or t
  misc_feature (647)..(648): n is a, c, g, or t
  misc_feature (655)..(656): n is a, c, g, or t
  misc_feature (664)..(667): n is a, c, g, or t
  misc_feature (679)..(680): n is a, c, g, or t
  misc_feature (686)..(690): n is a, c, g, or t
  unsure (1)..(692): unsure at all n locations
caattccatgatgtacgccaacatcagcggcggcagcgctctgctcaanctcaccgccgacggcaagctccngttcagcggctcgcagctcatcgcctccgaccaaggcaccaccaatcgggtgcggcggctcacgctcgacgacgacggcaacctgcgcctctacagcctggtgcccaagacccggaagtggctcgtggtgtggcaggtcgtgcaggagctctgcaccatccggggcacctgcgccnacggcagaatctgcgtccccgtcggcgnngacagcaccacttgcgtctgcccgccgggctaccgcaacgccaccccgacggacccctgcacacccaagnaaagntacagcggcaggggcgacgacgacangttcgtgcggatggacttcgtctccttctccggngccgcnnactcctcggcgtcggaccccgggccgctgatgaccaagcngacgccgcagaacctggcggnctgcgaganactctgccggagtaactccacctgcgtggcgttcgggtacaagttcggcggcgaccggacgtgcctncngttcnccgggctggtggacgggtactggtccccggcgacnnagatgtcgacgtatctncnggtggtggcgtcggacaatgacagcaacnngttcacnnggatgacnnnnatgatcgagacnntgtgcnnnnngc

SEQ ID NO: 1236 - DNA, 722 bp, Zea mays
  misc_feature (536)..(537): n is a, c, g, or t
  misc_feature (568)..(721): n is a, c, g, or t
  unsure (1)..(722): unsure at all n locations
gtctcacaatgttgcaatcatgcctaaatgcatgttgcaaatagaaacaactacacgaaaaacataatagtagctacacatgatgcacaccctgaggtgcacacaattatacatggcacaaaagaagggttccgctttggtgctcagagcctacctccaaaacttgctgccactccttactagtaagctgacaaaaagaaagcatgaaattcagtcaaagcaaacaaaatcaacatgggattacaaatgcagagaagtgcatctggatgttcaaaagaacctatggaaaaataaaggatacccaaaacttcaatatccaagatttaatttgatgaacatcaagagaaagacatagggacggaccttgtgcaaaatgatgtcaaatggaccttgttcagagagggggcaagtctcatcaattgatacgaaatgaatgcctttcttcctaaacaaatccagttttacaaaaggctcatcaaacggtataaaaccaaggcaggtaacagtataatggtcatattaacaagcatggactnncaggatcatctaagagcaacaactgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 1237 - DNA, 728 bp, Zea mays
gggggctctacctcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggtgcgcgggctgctataatttatccaaccatttgcaatttgcattttgctgggcaaaccatttgcaatttaccggtctatctcttgtttttttgtcccttcaggccttcaagtggctgtcaagtgcaagaacgccgacggcgtcttcgagaccaaggccctcggtgaggttgacaagtccggcagcttcagcgttcccctcccggctgacctcctccgcgaggacggcgagctgaagcaagactgcttcgcgcagctccacagcgcggccaacaagccatgccccggacaggagccgtcttggatcgtccggccaaccaccgacaacgacgacgacgataagatgaagaataccttcgtcgcagtcgccggcaaggtgcactacccatcaaaggagtgcgcctctgctttcctcttctaccatttgttcaagaagcacctgttgcacaagaagcccatggtgatcatccctcacatccacaagaagcccatggtgccgatgtaccgccactcgcccgtgccggagtacaagccacctcacccgacgcccaccccgatctac

SEQ ID NO: 1238 - DNA, 913 bp, Zea mays
atagtttcaataatcaactgaactagaaagtattcctgataaaatttctcacatatgtttttgtggtcacttttaagcaaatcagaagacatgtattgatttttttttctttatttggtgtcttttagaactatgctacaggtaaaaagttttttgcaatgaaaagatcttacctccttgacccaatgatgatactgatctttgattgttgtcttcctccatgcattcaggtcaaaaatattcataccatatgcccaagcacactctgaagggtcaaagttttttgcaatgaggggatgagaaaagttgaaataattcctgaacctcttagacatcacccgactgtctccacctatgcaagtctcaacagcaccattaaccttcccagctagatcgatatcccaaagtggtgataggtcatgctggacaacaacatcatcatcaagaaatacgaccttgttgaggcttgggaacaactgcatccacagattgcagattaaatcagtgtaactttcagcaaaaaaaaaaggatgcaggtcaacaaatataaccacattttgaacaagtttgtaccatatacaattatatatagactacatgcagagaaagctccagatatctcaagaagagggcagcatcacttactccttgatcccagcaggaccagcaaactagaacaggttcacagtgaatagttctacagagcaaaagtctaaaatgctttcaattcttttgcagttttcattgtttcaaaccatccttctatctatataagcacgatacttgtttcacccaacaaaaatggtactaggaaagtaagagatgagaataatagtcaagaaaattctaatacctcaggcaagtatattcgaatatgattgagtacattagtgtatgttggacttcctgcctg

SEQ ID NO: 1239 - DNA, 624 bp, Zea mays
tccactcaaaatcgccaggttggatttcagtgaccatcatttcttcagtgctcatgtaagtgcagccatctctttttatttttctcaccactgctaaattctgcatgaacaaatcaagacgcctaacaagtcatgaatcagaaaccacaccgatatgcgatacgatacggcgatacgtagtccagcatgtacatgaaacctgtgcactgcctaattctctgcaaaatatatgaaccactactcgcaacaatgcagccagctacttctgttctctgctaaagcaacataatactcgtagtttatgtggttgtgtatttgattaggggtgactattttccattcaccatgtgatggttgccttcctcttattcttgtttacctccaataggacctagagaaaattcaagaaacagcgaggaatctcatggacgagcacagcaaagataccatagtcttagttactgagaaggtagcgccttttgggtccttaatgtctaatcttttgcgtggtcatccattgtaattgtaattccaaactgccctttgtttgggcatgcaggattatgaccgtgatccagaggccctcaagacactggacgcaaacgtttgggtgctgtcttcttc

SEQ ID NO: 1240 - DNA, 761 bp, Zea mays
  misc_feature (237)..(237): n is a, c, g, or t
  misc_feature (239)..(239): n is a, c, g, or t
  misc_feature (394)..(394): n is a, c, g, or t
  misc_feature (745)..(746): n is a, c, g, or t
  unsure (1)..(761): unsure at all n locations
taagttatctacttatttgttccctattttcatttatttatttaaagttgagatttatccaaagtattgttagtgtaatgttttttcttctgccacattaggtttttgtcaatgcacggcttcatgtctcaggaggggctcttgggggtggtcgcatggtagaagactcctcaagcgttgcaggttccatattttaaactttctttgatgatcacatttttgtagtattcttttttnangtaaaacaattctgtggtattcaatagcaaattatacacttcttacaagtcaacatatagatttcactatctcagtttctttggaggttactagcagaaaagtaatttagaaatgattaatatattttactgaggttctcaacgttgtgtttttnggttgctggtaaattgctcatttgctgctatagttgattagtaaatatagcagtatttatgtcattactggttacttgtaatgcaaacctttttcattgaagtacatgttctgtaaaatactagaacatggtcagtactttcagcattggtcactaacttttatgttttatgcgagtaataatatttctatttccatgtttatctacttagtttccatgccatgccgccttttcagtattggacactgctgctggagtttggtgtgataccaaatcagtagttacaactccaaggacaggaaggtatagtgcagatgcagcaggtggtgatgcttctgtagagcttacacnncggtgcaggcacgca

SEQ ID NO: 1241 - DNA, 537 bp, Zea mays
  misc_feature (1)..(2): n is a, c, g, or t
  misc_feature (123)..(123): n is a, c, g, or t
  misc_feature (136)..(136): n is a, c, g, or t
  misc_feature (265)..(265): n is a, c, g, or t
  misc_feature (310)..(310): n is a, c, g, or t
  misc_feature (312)..(312): n is a, c, g, or t
  misc_feature (394)..(394): n is a, c, g, or t
  misc_feature (425)..(425): n is a, c, g, or t
  misc_feature (482)..(485): n is a, c, g, or t
  misc_feature (487)..(487): n is a, c, g, or t
  misc_feature (490)..(490): n is a, c, g, or t
  misc_feature (494)..(499): n is a, c, g, or t
  misc_feature (506)..(507): n is a, c, g, or t
  misc_feature (510)..(511): n is a, c, g, or t
  misc_feature (518)..(521): n is a, c, g, or t
  misc_feature (535)..(536): n is a, c, g, or t
  unsure (1)..(537): unsure at all n locations
nncttgccgccgtttgaaaacctgagattacaaagtagtgcatcacgccctgtaagcacaatatggaagaagtcatccacccgcttcgacagcgagtccaaccccaactggagcctttcagcncttttcgacatcngggagatgcagttcagcagttcctctctcctttccaagcaactgatatcagtgacaacaccagtgtcctgctttgtgttatcatcttggtgtcctctgtcaattattttctcaggcgccatcacttccnttgtatggccaatggtctcggtatcctccttgatatcagctgtancnattcctccttctgtagtaatactttgcagcatgatcacttcatgctgacagctactatcatcagccaacttgagattatccncatggcctcttccctgggctgtagtatctgncaggaccacttcctttgaacggctaaatgaatgagccaggctggcattctcctcttnnnncngancagnnnnnntcaatgnntgnngctgttnnnnacatacatcaacannc

SEQ ID NO: 1242 - DNA, 641 bp, Zea mays
  misc_feature (216)..(216): n is a, c, g, or t
  misc_feature (554)..(559): n is a, c, g, or t
  misc_feature (568)..(568): n is a, c, g, or t
  misc_feature (570)..(572): n is a, c, g, or t
  misc_feature (599)..(603): n is a, c, g, or t
  misc_feature (618)..(620): n is a, c, g, or t
  misc_feature (624)..(629): n is a, c, g, or t
  misc_feature (640)..(640): n is a, c, g, or t
  unsure (1)..(641): unsure at all n locations
gcatcagagctggtggttctttgtaaatgtgattctggaaaggacactgcacctttgattggcaagcttactgaaatatggtggtctttaaggaaaaggagggtatcactcttcggacatgcggcacatgcttattttcagtatctttcccattcatcaactgagcttcaatcttcatatcaccatgatgctttgaaagggaaaacaagaagctanactatgcgtgcgatgctgtatctacttcacataatgttgaactatggggtggaactgaaggaaacacttgaaagtgggctttcaacagttcctttattgccatggcaggtacgtcatgatagtgttctatattctataattttgggtgtatgttaatatttacagcatacttatatgctttggaaatatgcaggagattatacctcaactttttgcacgcttgagttcccacccagagaagatagtgagggaacttttggagagtatattgctgaagctaggaaagttatctccttgctctattgtatatcctacattggttgatatcagtgcttgcnnnnnngaaccctcngnnnagcttcagcgcatatcggactttatgnnnnnttatcttacatatcnnnctannnnnntctgctttagnc

SEQ ID NO: 1243 - DNA, 708 bp, Zea mays
  misc_feature (439)..(439): n is a, c, g, or t
  misc_feature (581)..(584): n is a, c, g, or t
  misc_feature (610)..(611): n is a, c, g, or t
  misc_feature (614)..(615): n is a, c, g, or t
  misc_feature (647)..(651): n is a, c, g, or t
  misc_feature (653)..(655): n is a, c, g, or t
  misc_feature (657)..(662): n is a, c, g, or t
  misc_feature (666)..(666): n is a, c, g, or t
  misc_feature (668)..(675): n is a, c, g, or t
  misc_feature (677)..(679): n is a, c, g, or t
  misc_feature (683)..(684): n is a, c, g, or t
  misc_feature (687)..(687): n is a, c, g, or t
  misc_feature (690)..(690): n is a, c, g, or t
  misc_feature (692)..(694): n is a, c, g, or t
  misc_feature (700)..(701): n is a, c, g, or t
  misc_feature (703)..(704): n is a, c, g, or t
  unsure (1)..(708): unsure at all n locations
cgagtatgggcaaaggtggtggtggatcttgattaccatcggatgcaatgagattgtcaaactgattcgcttcttcaccgacaacatggtcaccatcagtaacaggctcagtgttctgcaacaggtgccccacttcaccttcagctggcaccccaggaacctcgtttgactgtagaggcgtcaggaattcatctgtatcttcttttttatcgaggttgtcatagtcttcttcgtcccaatccgttggtaaggaagcttccctggtagcaccatcctctttgtgggagtgataatcagggtaagattccgtggcagcagtctctgtaggcaagttttgcaattttcctgcatagagcaaagtgagcaggatagggaggctttggttcttggaaatggaatgaaaatgtacgatgtttttgctagggttaggggaaaaaangcaaagaaagagaagagatgaataccagctgcgtgggtgccactgcttctgatagagacggcagcaaaggtaatgccggcgaggaagaaaaaggcagcaagtccaggtccaagaagccctgaggaggagctaccatatcaannnnttagctagctagaacatgggaaagtnnagnngagaagaagatggcggatggagtgagtctcannnnntnnncnnnnnnaccntnnnnnnnntnnntcgnngcngtnannngcgctnncnnagtc

SEQ ID NO: 1244 - DNA, 337 bp, Zea mays
  misc_feature (112)..(112): n is a, c, g, or t
  unsure (1)..(337): unsure at all n locations
agattggcaaaaagaagcatgaatcatccagctaaatgtcctatatgtgaccaagaacctgaaaccatcaaccacttggtggtgtcttgtgtgttttcacaagagacttctngtacatcatgctgagaaagtttgatctgcacagtttagcccctcagccgggtgctatctattttctggattggtgggagagaatttcagctattgtttctggtatggttaggaaaggtctggattctctcttcattccgggagcctggatgatctgtaagcatcagaatagagtggtgtttgatggagtttcaactttcactaaacctcactcttctcctcaagt

SEQ ID NO: 1245 - DNA, 794 bp, Zea mays
tgggccgggagcggaggggatggaggggctggagtggaagaagatcagtgccaagaggttcgggatcaaggagtccatgatcccccccgaggcctggaacgtactacaccgcctccgcagcagaggtgcgtcctccaccccaatgtccctgctagtgtttgctttgttgtcctgccaaatcctgaaatgccactgctgaggttggatttcagtccggtgtcctgcgactgaactagtggatcgagtacttagttacaggtcaaatgtcagaacaaatgcagacaggatttaatactcaactcagcctcatataaagcaaatataatagttgcattttacttaattagaattgaaactatcttttatctatactgcaacagaatccatctattttttatttgaataaatttgagtagtttggataaaatcatatttcagaatgaaagatgtaaggcatactttgttttgtgaagatataaatgtgactagaggagaaacggttaattggatatgaaaaatgcaaaaccatatttgtatcctgttcggtactagtagtcgattaatatagctaatcagatatgaatgtgatttcaattccattgtacttttctccatctgttaattaggtgcttgagtatcctttgttgttgctaggggtggtaatggatcacgatccaaatgtttcttcacgattcgttcgagcccttaattaattttagctcaaaaataaatagaaatacagcctgatccaaatacgatctgatccttaaattttatagcgtaaaatttaaatc

SEQ ID NO: 1246 - DNA, 590 bp, Zea mays; identical to SEQ ID NO: 314
  misc_feature (97)..(97): n is a, c, g, or t
  misc_feature (355)..(355): n is a, c, g, or t
  misc_feature (431)..(431): n is a, c, g, or t
  unsure (1)..(590): unsure at all n locations

SEQ ID NO: 1247 - DNA, 495 bp, Zea mays
  misc_feature (1)..(2): n is a, c, g, or t
  misc_feature (5)..(5): n is a, c, g, or t
  misc_feature (7)..(7): n is a, c, g, or t
  misc_feature (60)..(60): n is a, c, g, or t
  misc_feature (138)..(138): n is a, c, g, or t
  misc_feature (421)..(421): n is a, c, g, or t
  misc_feature (434)..(434): n is a, c, g, or t
  misc_feature (473)..(473): n is a, c, g, or t
  unsure (1)..(495): unsure at all n locations
nnacnantgcttcgtgggagcactgtatatataacgaattactcggcaggtgccaagcangcaagagctgttgccttttccgatggaaacaggggctcggggcagggacagggcagctcttgcatccagcaagttgcnggcacaacgggccaagaacacgcgcctccggaatgtttctttcacacacgagacgagaggatcggaggcagcgaggaagcagtgaagcacgcggcagcagcagtaccaaggccctggttcccaagaacacggaccagacaggagcccttgcttctcccaaggggattgaggcaccggcaccggcggacaggctcgcgacgagatcacacaaaacgcagagccatgccgttctagggagggagactgactgacagaacaggcagggtccaaggagcaggagggncacggggagcggngcggagaaagaaagaaagaaagtcagagtagagagacangggggaggggagcacgagacca

SEQ ID NO: 1248 - DNA, 575 bp, Zea mays; identical to SEQ ID NO: 444
  misc_feature (241)..(241): n is a, c, g, or t
  unsure (1)..(575): unsure at all n locations

SEQ ID NO: 1249 - DNA, 1313 bp, Zea mays
  misc_feature (1)..(2): n is a, c, g, or t
  misc_feature (4)..(5): n is a, c, g, or t
  misc_feature (7)..(7): n is a, c, g, or t
  misc_feature (205)..(205): n is a, c, g, or t
  misc_feature (268)..(268): n is a, c, g, or t
  misc_feature (402)..(402): n is a, c, g, or t
  misc_feature (550)..(555): n is a, c, g, or t
  misc_feature (575)..(579): n is a, c, g, or t
  misc_feature (584)..(585): n is a, c, g, or t
  misc_feature (591)..(594): n is a, c, g, or t
  misc_feature (605)..(607): n is a, c, g, or t
  misc_feature (610)..(610): n is a, c, g, or t
  misc_feature (630)..(631): n is a, c, g, or t
  misc_feature (633)..(634): n is a, c, g, or t
  misc_feature (636)..(638): n is a, c, g, or t
  misc_feature (640)..(641): n is a, c, g, or t
  misc_feature (658)..(660): n is a, c, g, or t
  misc_feature (662)..(662): n is a, c, g, or t
  misc_feature (667)..(670): n is a, c, g, or t
  misc_feature (674)..(675): n is a, c, g, or t
  misc_feature (678)..(679): n is a, c, g, or t
  misc_feature (683)..(688): n is a, c, g, or t
  misc_feature (695)..(730): n is a, c, g, or t
  misc_feature (738)..(748): n is a, c, g, or t
  misc_feature (751)..(751): n is a, c, g, or t
  misc_feature (753)..(771): n is a, c, g, or t
  misc_feature (779)..(846): n is a, c, g, or t
  misc_feature (849)..(851): n is a, c, g, or t
  misc_feature (886)..(888): n is a, c, g, or t
  misc_feature (890)..(891): n is a, c, g, or t
  misc_feature (893)..(911): n is a, c, g, or t
  misc_feature (918)..(930): n is a, c, g, or t
  misc_feature (949)..(951): n is a, c, g, or t
  misc_feature (959)..(959): n is a, c, g, or t
  misc_feature (971)..(971): n is a, c, g, or t
  misc_feature (973)..(980): n is a, c, g, or t
  misc_feature (995)..(996): n is a, c, g, or t
  misc_feature (1008)..(1012): n is a, c, g, or t
  misc_feature (1037)..(1038): n is a, c, g, or t
  misc_feature (1056)..(1058): n is a, c, g, or t
  misc_feature (1065)..(1067): n is a, c, g, or t
  misc_feature (1073)..(1075): n is a, c, g, or t
  misc_feature (1088)..(1088): n is a, c, g, or t
  misc_feature (1128)..(1130): n is a, c, g, or t
  misc_feature (1193)..(1197): n is a, c, g, or t
  misc_feature (1237)..(1239): n is a, c, g, or t
  misc_feature (1247)..(1254): n is a, c, g, or t
  misc_feature (1265)..(1269): n is a, c, g, or t
  misc_feature (1281)..(1292): n is a, c, g, or t
  misc_feature (1294)..(1299): n is a, c, g, or t
  misc_feature (1311)..(1312): n is a, c, g, or t
  unsure (1)..(1313): unsure at all n locations
nnanntnatggagcttatttcctttcaagtttgaactatattttcttgctatttattttccaatttgaactatatggctgttatgacttatgagtttatgacttatcacttatgtggctgatttggttcagtttgaggcttcaaatgaggtaagacttgctgtttatttcagttttgttcaatttcaggcttcaaatgaggtaanacatgctctttattcatatataaatgctatattgtctatatgaaaccattatataggcaaaanagccactatattggcaagtcgacgactagtcgactgaattatcaactagtcatcaagtcggtaccttgtcgacttgaaaaccttgcatatgtgtaatactacaagttatctaccaattagggttttatttctcnaacatgttatctagccagtctccttcccctctgctcccctagccaccgccgctagaaattggcggccgatggcggcggccaagcccccatggtctacactccccctcctctcctcccttctatccctagtcgctggcactcctctctnnnnnnctaatggcgctcctgtgatnnnnncagcnnccattnnnntcaatctgtcnnnaanagtttctattggatgaacannanngnnncnngatgttcatgttagacnnngnatctnnnntatnntannctgnnnnnnatatctnnnnnnnnnnnnnnnnnnnnnnnnnnnnnnnnnnnnatgtgatnnnnnnnnnnntantnnnnnnnnnnnnnnnnnnngtcatggnnnnnnnnnnnnnnnnnnnnnnnnnnnnnnnnnnnnnnnnnnnnnnnnnnnnnnnnnnnnnnnnnnnntcnnncacatgcacaagaaaagaatccataacatgtacannntnngnnnnnnnnnnnnnnnnnnntatggannnnnnnnnnnnnagggacacaacctgagacnnntaggtagnacccatgtttgncnnnnnnnntgggtgcatcagttnnttgattcttaannnnncttttgggattaaactgcaatgagnnttttttttctatccctgnnncgttgcnnnaaattnnnagatcaagcttcntggtgaaaaaagatgacatgtctgctttgtgtggtgttannnagaaaaaaacggggctcttacggtcaggagtgcagatagagttgcaatgtgcttacagatgannnnnacactcatctatacaagctaattgtgagtcatgtgattannncatggagnnnnnnnnccatgcatgtnnnnncagcccatgcannnnnnnnnnnntnnnnnntgcacgtgtacnng

SEQ ID NO: 1250 - DNA, 430 bp, Zea mays
  misc_feature (256)..(256): n is a, c, g, or t
  misc_feature (413)..(413): n is a, c, g, or t
  unsure (1)..(430): unsure at all n locations
ttaaccattcctccaccgtgacaaaatatttacgtgaagattgcttacggttctttgaattcctattttttgtaacatgccagtccatgtgagcacgatgctcctcttggcatttaaatcgaaggccacaagttttacactgccttgaaagatcctgatacaaagcattgatgacaggctcattccgtaccttgaggtctacattgaagtcaactccaacagaatcctacaataaaatgttcacaattttcccctnaattaacagcataaatataaacagaataatactatataacaacgcatgaagcatgagaaatacctgggattggctaggtggttccagtgaaattacaccatgccgcataaggttactcaaaagtccagagacaaatggttgagggccaccaacttgngatgatgatgaacccat

SEQ ID NO: 1251 - DNA, 698 bp, Zea mays
  misc_feature (242)..(242): n is a, c, g, or t
  misc_feature (268)..(268): n is a, c, g, or t
  misc_feature (284)..(284): n is a, c, g, or t
  misc_feature (368)..(368): n is a, c, g, or t
  misc_feature (545)..(545): n is a, c, g, or t
  misc_feature (557)..(562): n is a, c, g, or t
  misc_feature (565)..(565): n is a, c, g, or t
  misc_feature (573)..(581): n is a, c, g, or t
  misc_feature (584)..(584): n is a, c, g, or t
  misc_feature (588)..(596): n is a, c, g, or t
  misc_feature (603)..(603): n is a, c, g, or t
  misc_feature (605)..(697): n is a, c, g, or t
  unsure (1)..(698): unsure at all n locations
cagttcggggtcaccgtcaaccacgtccacgcgatcgccattctcatcgccaccttcaactacgataagtccccttccgctatcgaccaggttcgtcaccatgcattcgcccccctcttctccgccattgctcttgtagattgctatgccacggtatcaattggcagttggtttagcaatagcggaccccgagatcctacacattgttctgtgggttgtctcttttctttaaaggagcaaanagaaaaaaaaggggagaaatagaganatagagatgcgttgtngtttgttgacgcttaccgtcgtttagcacgccatgattgctgtggttggctgggacaggtgctgttcatagtcttgtggaaagnaaaaaaatgtccattcctgcggcggttaggcggggattttttaggcttattggagacgtagctgaactgaactgttgggttggtggcacattgtttgttcatagagtgattagtgtgttcgctgcaaaaccatctggggggttactttgacatccattggggtgtgctcttttgccnaccttttgattnnnnnnttnttctgagnnnnnnnnntgncgcnnnnnnnnnattatgntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 1252 - DNA, 535 bp, Zea mays
  misc_feature (22)..(22): n is a, c, g, or t
  misc_feature (86)..(86): n is a, c, g, or t
  misc_feature (89)..(90): n is a, c, g, or t
  misc_feature (165)..(165): n is a, c, g, or t
  misc_feature (180)..(180): n is a, c, g, or t
  misc_feature (188)..(189): n is a, c, g, or t
  misc_feature (526)..(527): n is a, c, g, or t
  unsure (1)..(535): unsure at all n locations
atacaatatccatccttcatanacaagcctttcatgatcacttgcagcatgctcacgagcaagctgcaaactcctcattgccgccncannacagtttaatctggtaaggcaaaataaaatcatatcaatcctaacatcccaaatagcaatatcatatgacatgcngcaagttagcacttngcacagannacatgtgcaaacatgctgacaagacaaacatgtaaaaacattccagctttcagacacatgatactagtaggtggaagacatgccaagacgccaagttgccaaaccatgtgcaacagcatgaccatctactatgaccagtattgtgttactctataatactggactaggctaactattcttctaagcaataacgtaaatcaatttatttacctgagaagaagcaaagattgtctaaagtacaaaactcctttggcagtctctgactccagcatttgatatataacagagagggaccctatatcatccacagacgaccagcgatcataaagttgcatcnnacagtcag

SEQ ID NO: 1253 - DNA, 531 bp, Zea mays
  misc_feature (5)..(5): n is a, c, g, or t
  misc_feature (104)..(104): n is a, c, g, or t
  misc_feature (131)..(131): n is a, c, g, or t
  misc_feature (339)..(339): n is a, c, g, or t
  misc_feature (368)..(368): n is a, c, g, or t
  misc_feature (374)..(380): n is a, c, g, or t
  misc_feature (388)..(388): n is a, c, g, or t
  misc_feature (408)..(408): n is a, c, g, or t
  unsure (1)..(531): unsure at all n locations
tgccnaaccgtccggttttgatatcggatatagagatcagcgctgcaaccagaccagcattcgctgcgagagtaggctccgtgtagttgtagttcgtgcggacntctttgtagccatcacgcctgtcgggnccagccaccattgctccgacaaggatgttagggtttgccttctttgtgtccctccacttgtaacctcctttgcacccatacttgacgccgttgtgaggtatcgacgcgcctctgtgatgagggcgcttcgggtacttgtttccgaaacccacaacgtagctcatcttcaatgggttcttgccaaggatgtagtcgagctgcaaatttnacagatttaatttaactatcaatttcacntccccnnnnnnngtacgttnggcactttgagagcattaangaacaatgcttttacctgtgacctggcaaacttgcggaggacttctgtggtgtagaagttaggtccgcagtaccacccaggcgtgtctgcagcttcaagatagtcgctgtatagagaagcaag

SEQ ID NO: 1254 - DNA, 766 bp, Zea mays
ataaggcttggcagctccagaaccagcaaccatatcaaacgatgacattacaagttgcatccgatgataatagtgtttgtacttccgatccacctgaaagcaaatttcaagttgatcttaaaaattcagacataccagatactgcattagtgaaactatcaaaacacgcctagcccattcatctgatctgtcccagttagaaacaattttgtcttgctgagaaaaaaatgtatttatgcacccatcttacattttaatggggtaatgtaaccttctgcatttgatggtgatcttgtcctgaataacagttttgtggatacatctgttcctattccaaatatgctcattgcttgtttggaggacctttagctaaaaacatgcaatctacagatttaagccttgttaaatgacaatgattgtgggcacctaggcattattaagaaggctagacccacctaaactaacaatgtttgacgagtcctccaagaattttcaagaaatcaacttgtgaaactcatggagctgaaccaatataaatgacctttgcatcaggaaccaactattggactcattatttaggtcacaactcaaactgaactgatggggttgggattcctcgagtatttctctaggaacagaaggcagaaaattgttgacttctgatataccagtatgagaaaaagtaatatgcagccatccctagataaagtattagtttaataaaattcatatttggaatatcaaaagattattggtgaaactaata

SEQ ID NO: 1255 - DNA, 699 bp, Zea mays
  misc_feature (9)..(9): n is a, c, g, or t
  misc_feature (225)..(225): n is a, c, g, or t
  misc_feature (237)..(237): n is a, c, g, or t
  misc_feature (396)..(417): n is a, c, g, or t
  misc_feature (429)..(429): n is a, c, g, or t
  misc_feature (497)..(497): n is a, c, g, or t
  misc_feature (558)..(558): n is a, c, g, or t
  misc_feature (604)..(604): n is a, c, g, or t
  misc_feature (642)..(642): n is a, c, g, or t
  misc_feature (651)..(653): n is a, c, g, or t
  misc_feature (679)..(680): n is a, c, g, or t
  misc_feature (686)..(687): n is a, c, g, or t
  misc_feature (689)..(691): n is a, c, g, or t
  unsure (1)..(699): unsure at all n locations
aaagtcgangaaactagcacggaatcagaatatttgttcttttctgactccatcttctcattctgggctaggctgaaattttgaaggactgattggagggattcagcatcatggcgctctgtagaggaaatgctcttgtggctaggctggttgccaccccaggctttcaatattgtgtctgggtttgactcattttccagtgtggggcctaacttatctggtttnttttgctgcttnagctgagagagcagggacaaggtgggttggctgttcgtagaagtaagcagcaaagagctatcttccgtcggtttgtttgctttctctctgctcaacattgtcctgaaaatgagtacaaggttgtggaatgggaattattatgactgctaagtggcaacnnnnnnnnnnnnnnnnnnnnnnctagaacctcancatactaacattattccaggatgcatgctcttaataggatgcacaagtattaaattgggattttattnttcagatatcatgctaaaatagggtgccttatataaggagatgactctggtgtaagaatanagtatttacctgtttaaactatctgcccaatagctgacaatgcctngcttggagtcattaacttttgccttcttcaagctaccntgtggcccnnnacatggcaatgagccagcagcagcanncacctnntnnntggtcttc

SEQ ID NO: 1256 - DNA, 649 bp, Zea mays
  misc_feature (185)..(185): n is a, c, g, or t
  misc_feature (635)..(640): n is a, c, g, or t
  misc_feature (642)..(644): n is a, c, g, or t
  unsure (1)..(649): unsure at all n locations
ggtccgtaaatatcatgccgaggatacactccggccactattttactccatccactgtacccgagcagaccacggtcgatttggatgggttcgccggagatagccacttcgcggccttgctccacgttccttggcacattaatctcatcgccgtgactcacgttagctcgtctggtggtcgccgnggagcttgccacggtaattgccaccaatcgcgcacgccagtaaccttcttctccggccgccatgcgtctttctcaaattcactggccaccgctgtgggagcctataaattgctgacctcgcctgctccgctaagtaattgtgcaactagtgaagcaacccgtgtctcgaatcatccactagaactccccaatttgggatttcccccaaatcactcaagaacaccgagcagtgtgacctcgccgtggtccgctcgtctcaggtccgctcataccctatgcccttccgttttagtgttcttgtgtgctcctgatactcgtcgaccaacttaattgagctaaggtaccttagatcgccgggaccgcattagaatgtccgttgatcatacggtcaccgtggacagagcaggttagagcgctgttcgtgaaattagttgaggggaaacgattatnnnnnntnnnatttg

SEQ ID NO: 1257 - DNA, 502 bp, Zea mays
  misc_feature (134)..(134): n is a, c, g, or t
  misc_feature (325)..(334): n is a, c, g, or t
  unsure (1)..(502): unsure at all n locations
tgaagaatattcattcgggcttgggaactgcaaaacaccagcagagaattaattgacaactgtactgtgtgtgtatgcgcgcgctactaacagtcagaatacatgttttgagattaacatacctgtgctttcanttttgatttccatgtcacctcgacaaggttaatgcttattccataagcaacaaccaatgtagcaagatccctcacataccgagatgacaacagaaccttcatgctctcacccatgctgagctttggcttgtcctgaaaggttatgttcgcagaaccgttaaggagagatccataaacacaagaagaagaannnnnnnnnntctgccaggcccaaccttctttttccgctcaaccacgggcacagatgagttatcaataacaaacttgttcactccccaatagataccggtgatgacaagacccagtacaaccactatgctcatcatggccttcaacgaaattgcccaaccatccactccaggacccaa

SEQ ID NO: 1258 - DNA, 456 bp, Zea mays
  misc_feature (124)..(124): n is a, c, g, or t
  misc_feature (127)..(128): n is a, c, g, or t
  misc_feature (204)..(204): n is a, c, g, or t
  misc_feature (253)..(255): n is a, c, g, or t
  misc_feature (279)..(279): n is a, c, g, or t
  misc_feature (351)..(351): n is a, c, g, or t
  unsure (1)..(456): unsure at all n locations
ggtgtcattcccctggcgcgggtgttgtcgatcgagtgacggctgggctgaccaacgaggcagccccggccccgccccccagtcagccatgagcgcctcctcctggctaacggaccgtgtccgngtnnccctttcggaacctcgtgttgcggcgacactgctgtgccgtgcgtgttcctctctatcgtctgtctagtatacagngctagtgccgatgatcggatcggtgtcgccgatcacgagatcgatgggnnntcccggcggtcggcggtccccccngtgcgggccggcccgcctgacgacctctcaaggttggtagtaattttttttagtgcttgtcgttgaccgctnttgctcccttttttcgagcttcggtttccgtactgtagattagttttgctgcgcgtaggaagcttcgtaggttccccagtacgcaatattggcgtttgcttccga

SEQ ID NO: 1259 - DNA, 706 bp, Zea mays
  misc_feature (19)..(130): n is a, c, g, or t
  misc_feature (479)..(479): n is a, c, g, or t
  misc_feature (510)..(510): n is a, c, g, or t
  misc_feature (536)..(540): n is a, c, g, or t
  misc_feature (585)..(587): n is a, c, g, or t
  misc_feature (589)..(589): n is a, c, g, or t
  misc_feature (607)..(607): n is a, c, g, or t
  misc_feature (621)..(622): n is a, c, g, or t
  misc_feature (652)..(653): n is a, c, g, or t
  misc_feature (655)..(655): n is a, c, g, or t
  misc_feature (658)..(661): n is a, c, g, or t
  misc_feature (668)..(668): n is a, c, g, or t
  misc_feature (670)..(670): n is a, c, g, or t
  misc_feature (685)..(691): n is a, c, g, or t
  misc_feature (695)..(699): n is a, c, g, or t
  unsure (1)..(706): unsure at all n locations
catcaggattctccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatcgaagaagccacactgtaaatctgccgggaagcggctggtggcatccggcccgctcctccctccgggcgccgcaacttttttcgatcggttttgcgccgcccgggacgggttgtagttgatcgattggattcttcataactgtatttgcgtactgcttacactacccaagtgaaatcgaaaatggcgccttctctcgttgaataaattgcacgtacgctactcgatccgctgcggctcttgctggagtggccgccgccgctatagatagaaggatcaagccaaggaatctgtcatgcatggccatgtgaaggaggagcctcctgcaatgtttagtcttttttgntcgacgcccaccagagatatacgcactagantttcatatagctgagctagatcgatnnnnnccgttgcatgcatgctccatgccgtcgagattcgagctagcaccnnntnttcatcatcgaccgatcnattctgatcgattnncctctcgagctttcacgaactgaacctacnnantgnnnntgacgcntnacgcctagtgcgcgnnnnnnnggtnnnnnatgtcag

SEQ ID NO: 1260 - DNA, 737 bp, Zea mays
  misc_feature (15)..(15): n is a, c, g, or t
  misc_feature (130)..(130): n is a, c, g, or t
  misc_feature (141)..(141): n is a, c, g, or t
  misc_feature (151)..(151): n is a, c, g, or t
  misc_feature (180)..(180): n is a, c, g, or t
  misc_feature (200)..(200): n is a, c, g, or t
  misc_feature (208)..(208): n is a, c, g, or t
  misc_feature (214)..(214): n is a, c, g, or t
  misc_feature (217)..(220): n is a, c, g, or t
  misc_feature (222)..(223): n is a, c, g, or t
  misc_feature (236)..(236): n is a, c, g, or t
  misc_feature (289)..(289): n is a, c, g, or t
  misc_feature (409)..(409): n is a, c, g, or t
  misc_feature (463)..(463): n is a, c, g, or t
  misc_feature (617)..(619): n is a, c, g, or t
  misc_feature (623)..(629): n is a, c, g, or t
  misc_feature (637)..(640): n is a, c, g, or t
  misc_feature (649)..(652): n is a, c, g, or t
  misc_feature (661)..(662): n is a, c, g, or t
  misc_feature (664)..(673): n is a, c, g, or t
  misc_feature (675)..(679): n is a, c, g, or t
  misc_feature (683)..(692): n is a, c, g, or t
  misc_feature (697)..(702): n is a, c, g, or t
  misc_feature (704)..(736): n is a, c, g, or t
  unsure (1)..(737): unsure at all n locations
aagttcaacggcggnggtgagtcactgccctgtactcgctccacatctatccccttcttgggtaccatgctttttcttattttgggggattattatctgagcggggcgaattttatgggttcgatgaagnctaagtgcggnttttttcccnatctcgtgtgatctgattacgaaaaggtngatgttgttgacctccctgntttcagcnagtgtnccnnnncnntgtaccctgaggntttcggtggctgtggtggaggttttctcatagacaataaatgcagatttaganggaccatcgaaggctcggtgggatccaattaggatagtacatgttggagtctgcccccctgcctcctattagtgcttctgtaacagtcgaattttcgagattagttagtgctaccattangttcgtcttgtgtctattattatgtgattttggtattatttacctttttcctgnatctagctgcatgtcctttctttactatactgatctagagctgatggtactagtagcatttgcccggttgtggttgggttaagttcttgttgtgcagcaaccagtgtgatttggttgcctattgaaacttttagagctgtagttactgatgttnnnaccnnnnnnnttaaatannnngctatgacnnnngatggcagnntnnnnnnnnnncnnnnnaaannnnnnnnnngagcnnnnnnannnnnnnnnnnnnnnnnnnnnnnnnnnnnnnnnc

SEQ ID NO: 1261 - DNA, 534 bp, Zea mays
  misc_feature (221)..(221): n is a, c, g, or t
  misc_feature (262)..(284): n is a, c, g, or t
  misc_feature (293)..(293): n is a, c, g, or t
  misc_feature (461)..(468): n is a, c, g, or t
  misc_feature (471)..(471): n is a, c, g, or t
  misc_feature (491)..(491): n is a, c, g, or t
  misc_feature (493)..(493): n is a, c, g, or t
  misc_feature (518)..(522): n is a, c, g, or t
  unsure (1)..(534): unsure at all n locations
cttggaatggtgccgcaccgtacgtgcgatttagacatgtcacctactacacacatgcatgcatgcatgcttgcataactctaagcctctactacaagtctacaagctaacaacccaacgccaaacatggagcgcggacatcccgcatgattcagtctctgtgttaatttctttgtgtttgatacggtgtttaatctcttcttcatagctgtaccaacttngttgcacagcgaaccagatcgtacccgtgtcgtgttcgttnnnnnnnnnnnnnnnnnnnnnnncgagacgangaacgcacctcatcggtcgtcgccacctgaccgccgggatgggctgctgccgctgccatggtcctcccgccggaatctgttcatcgagagaaggaactggaatgagaatcatcacaaggcagtacaacgttgcccgcgctacgtacaaaagggaagctctgctcagcnnnnnnnngancatgcggtggttctgcatcnantactgggacttcacccaagctaccnnnnnactgcatgcgca

SEQ ID NO: 1262 - DNA, 1099 bp, Zea mays
  misc_feature (106)..(106): n is a, c, g, or t
  misc_feature (140)..(140): n is a, c, g, or t
  misc_feature (357)..(357): n is a, c, g, or t
  misc_feature (712)..(712): n is a, c, g, or t
  misc_feature (717)..(717): n is a, c, g, or t
  misc_feature (769)..(769): n is a, c, g, or t
  misc_feature (1013)..(1014): n is a, c, g, or t
  misc_feature (1021)..(1021): n is a, c, g, or t
  misc_feature (1072)..(1073): n is a, c, g, or t
  misc_feature (1079)..(1094): n is a, c, g, or t
  unsure (1)..(1099): unsure at all n locations
cgaacatgcatatttgatgcctcttgtaaacaacattacactttcgcgtttttatcaatagtctaacttatgaaaatgctttgttatctgcccaccaagatgacanacttctccttaccaagcctgctttatgatctttntgtttaaatctttttgggttcactaaattgccattatttctcttgtccttttttctaggaagaggaagaagaagctctaagacaactgaggaagaacttggtcgtccgagcaaaacccatgccaagcttctaccaagagggacccccaccaaaggttgaacttaagaaggtaatgtatttcctgttgtctgctatgttattttaatcagttacctgnttttttttcattgttcaatctgtatttacattctgaaggaatcttttaggtattcaattagtttcataagttattctgctttatcattactcagatttttttcataagttcatattcattgctctggtgctgcatcaattcatctttatagctccagttttgtgtttttgctttgtatatgttgcttttctttgggtgccaagacactacgtcaaggttagggggatccttatcctattttgttcctttatgttcctgattcttttatatacctcaaaattaacatatagtattttgatattttgtccaagagaaatatgcttgaaacagcatgattcctgggtttccaaatgcntatgncattattgtccttgtgtctggccataattgaaatttcaatttcctggacacngttgcgtctttgcatttgattctcgcaaaacaaatgaatgccattttcatcatcgacttggtcagaagaaatgtaaaatttttatcactgaacaaacttgtaatgttgctactccaataaatcaccaaaaatagtacaagctgtatgtatagaacgagtttaaatgtcttcttacattaatttatattagcctgttgattaaataatggaaagatgtataagctttcctgcttttagcatgtannagtgcgngccttcatatatatatttatttgccttttgtcaggtgcctccaactcgtgnnaagtcnnnnnnnnnnnnnnnnagaaa

SEQ ID NO: 1263 - DNA, 953 bp, Zea mays
agcgtcacgtaggagggagtactagtacgtcgccggccggacggccgggtcgacgacgataacgatcggtcgatggatggatgggtgaatggatttgacgtgcgtgatggaacagcagaacacttggcaatgcaacgacccgtggtccgatgcgtccgtggcagcaggcacgggcttgctgatggatcatttaatatatatatatatatatatatatatatatataaggcataggaatgcatagaaaagaaaaaaaaaaaagagatggtcagaggagctggtggcgctgtcccgtccgtgcacggttacacttacccacgcacgcagagggatcggaggagctggtggtgctggtggcgcgctagctagctctctagataattgcgcgcgagcatgcactgcactgcactgcaccgcacggcccgtatcctcatggtatttagtgaccaaattgttctacccgccaccgcctgcatgcggctgctgcactgcatctgcatgctgcggcagtgcgcacacacgcgcatgcttaattctctctccgggtctggtgggctgctggctctagctatagctgcctctgtgtggttgtacacaacgagagatacttttgtttcgtgctgccgctgctgccggccggctgagactgcctgcttgcaagtttcaaggcagccccgtgacttccatggaacagcaacacaccagacctgctgagacctcactcacacacacccaactctggcctctcgatcgatctcacaggtcgagagagaggagagagagagagagagagagagcagtatagtagtacagtggatactagtagtaaatggagagagttatgaccatctatccagactccagagaggggtgcaagtgcaatgcaaagctagctaggcagggggaggggagggatccactttcgaggagggcagtgcatgcaatgcaatgca

SEQ ID NO: 1264 - DNA, 689 bp, Zea mays
  misc_feature (585)..(589): n is a, c, g, or t
  misc_feature (604)..(607): n is a, c, g, or t
  misc_feature (610)..(611): n is a, c, g, or t
  misc_feature (635)..(636): n is a, c, g, or t
  misc_feature (650)..(653): n is a, c, g, or t
  misc_feature (663)..(665): n is a, c, g, or t
  misc_feature (667)..(667): n is a, c, g, or t
  misc_feature (675)..(679): n is a, c, g, or t
  misc_feature (682)..(686): n is a, c, g, or t
  misc_feature (688)..(688): n is a, c, g, or t
  unsure (1)..(689): unsure at all n locations
ccaaaagaagcgagtttgggaagcttcctgcctgctttccagggtttagtgggcccctaccttaagataaaatcaaagagaggtctcacctccttttttctctctctcagacatacaggagagccacatatctttatattgaagagagaagaactggtcccttaaagcaaccgctctgactccacttgacctatgttttttcccttcttgatcttggtcactcaaacaaatgcgctgatcatatttggacggagtagtagttagcaccttccacagcactggagcactattttactttttgtatccatactcactgtttagcgtttcttttgtgaaacatattcactagttactaatttcaggaagatggcaatgccgagctcaacgatgactatgaggcatctgcgtgtgattctgttgcaggtaaaacgtatcagtactttaaatatgttatacattgttatgcacttcattcatatctgttctaacttctacacagtttgttcagatttgccccaggagaatgcatacgaggaggatgaaggcgagacatgtacttttctttctcctaaagcatatgttggnnnnnccatatcgaatatgnnnnacnngaagaaacatgtaatgccacaaannattagccttgctannnnatatgaaatnnntncctatgtnnnnnatnnnnnang

SEQ ID NO: 1265 - DNA, 593 bp, Zea mays
tgccaacactgaagttcgagctgacaaacttgctacaagaccagcctttgcaatagaaacacattgctgctccatggcttcaagtaaagcctgagaaccagaaacaattagaaacacaaatagataggcatgggaacttcctcactggtgaaaacttcatgagaaagcttcatataaggtgaaaaataattgtaatacctgatgctctgtaaacattttatcaaactcatcaatacagcatattccacgatcagcaaggaccatggcacctgtaagtcaaggactcaacttaattttgaatttttgatcgcattgcaaattctaaaaccacaaagaaaacgtacaccagaacaaagagcatttggaacggcaattggtataacaaggaaaaaaacaaaaatgccatcgccaagacacgattttgaatagaagacttaaaaaatcataatgaacgaatatatgttttgtggttaccagcctcaaatgcataatcatttgtcatagaatctttaaccacagcaacagttaggccagcctttgttgtcgtattcccacatacatatattcctcgtggggaaacaggggttccgagc

SEQ ID NO: 1266 - DNA, 1322 bp, Zea mays
aaacatctgatttgggagattatgggtgctatttcctatctctcatcttatctatcgcatgacaggtaaatctgcggcgccctcgattgtcgattcggccgggggtgcagaaatccgatgataacctattattccagattccatgaagtgcgcgtgaaagttacaaacatatctcgaggaatcagctttctaaagcacgcgttctgacttctgagttactttgttttggtatgtttcttggtgatattgactattgagggcctggatctatgcgctcgtagaaatgcctaatctcttgtaaataggttgtggtttcaacctcatttccgagctgactagatggtcgatttatttttatgggggctattctaatccgtcagcctgatgattagcattctttgcacaaaaaacggagatctgaatgtgctttccgtcgaagcctgcttgaccgctgtggtgggtcatgtgagctcagctcgttgatctccctgactactacctccgtggctccgttccaaattataagtaattttctctcagggaaactaccagctactacacacacatgcatgcatctatctatctatctatatatatatatatatatatcctcgcccttcttccaccactgactggctgagcaggctccgggagatgcatatgtagatgcaagagttatgaaggctatcccagattggattgcggtgcctaaattcatttttaacttgtttaacgagttctttatcactatctgaaaagctgttcctattatagagtactgcaatgcaccgtggtctgcttgtgatttggtcagcatcacattaatgattttgctttagcttgactgatattcgaggtacaaaatgcagtatttaaccctatggacaaaactggaagattatgtgaattaaagaaagttgcatctgctgtgctcctggttcatgggggcacaatggcatgatgactatctaggggaatctctgatgctaatgctaatacaaattttcttatctagcttacacggtggataggttaatgcgtgtagaaccatgctagtgatagatatcctttgaacctggagtaaagcattttatatgcttatttacggccataaaagttttctggcatctcatatgtgactgagataagccattttagcttgggtgttggttgcctggaattaagtcactatctgttgatcctttcctttcagaaacatgtttggtttgtgtgttgtcatatttttgccacttcaccgcataagaaaaatgtcagatagtgagaagattgaagaaagacaagaacatctgcaggcatgcaaa

SEQ ID NO: 1267 - DNA, 486 bp, Zea mays
  misc_feature (1)..(9): n is a, c, g, or t
  misc_feature (123)..(123): n is a, c, g, or t
  misc_feature (130)..(130): n is a, c, g, or t
  misc_feature (150)..(226): n is a, c, g, or t
  misc_feature (244)..(244): n is a, c, g, or t
  misc_feature (266)..(268): n is a, c, g, or t
  misc_feature (416)..(416): n is a, c, g, or t
  misc_feature (463)..(463): n is a, c, g, or t
  unsure (1)..(486): unsure at all n locations
nnnnnnnnnctggtctctgctcgccctgcactaccagcagcagcaggagcaggagcggcagttcccggcttctgcttacgaggcttacggctccggcggcgtgaacgtggacttcacgatggncaccagnagcggcaacaacaacaacannnnnnnnnnnnnnnnnnnnnnnnnnnnnnnnnnnnnnnnnnnnnnnnnnnnnnnnnnnnnnnnnnnnnnnnnnnnnggcaacggctatgccagnaacattccttatgctgctgctnnnatggtttctggatctgctggctacgagggctccaccggcgacaatggaacctgggttactacgactaccagcagcaacaccggcacggctccccactactacaactatctcttcgggatggagtaggtgcatgcgctgacaagctagntagctgaaatcaggtggtaggcctaggaagaagctaggactgacatngaactgatcacaattttggctgc

SEQ ID NO: 1268 - DNA, 474 bp, Zea mays
  misc_feature (35)..(35): n is a, c, g, or t
  misc_feature (67)..(67): n is a, c, g, or t
  misc_feature (73)..(73): n is a, c, g, or t
  misc_feature (146)..(146): n is a, c, g, or t
  misc_feature (156)..(156): n is a, c, g, or t
  misc_feature (236)..(236): n is a, c, g, or t
  misc_feature (247)..(247): n is a, c, g, or t
  misc_feature (316)..(316): n is a, c, g, or t
  misc_feature (318)..(318): n is a, c, g, or t
  misc_feature (362)..(362): n is a, c, g, or t
  misc_feature (404)..(404): n is a, c, g, or t
  misc_feature (408)..(408): n is a, c, g, or t
  unsure (1)..(474): unsure at all n locations
tttcttgtgtaatgtaagcttgctaaatggcaaanattgactaacaagagatgatggaccaacaagngaatgngatcgtttgacaatgacatcagggtcattgtaaacctcatcgttggactcagccacaggtgctggactgcccngagtgagaanactcacttctgtgtgtgtatggacagcactaggcccaaaaacatcagaaaaatcgaactcaacattttcagaaggcacancatctgagganccccctggcagaaggatcttccctctaaaaagcttggagccctgtgcacgcgtcactgtgacagaggtnanctcagaggaaaccatcttcgagaacctatgagattccgcaagangactaggaagtcttgggccacaatttaaggaaggctccttcnacanattcccaagacaacggaagatgcagggctgcgaacaatggccttgaacaagtggaaattgacgaaa

SEQ ID NO: 1269 - DNA, 785 bp, Zea mays
  misc_feature (6)..(18): n is a, c, g, or t
  misc_feature (35)..(37): n is a, c, g, or t
  misc_feature (131)..(131): n is a, c, g, or t
  misc_feature (133)..(133): n is a, c, g, or t
  misc_feature (187)..(187): n is a, c, g, or t
  misc_feature (229)..(229): n is a, c, g, or t
  misc_feature (253)..(253): n is a, c, g, or t
  misc_feature (279)..(279): n is a, c, g, or t
  misc_feature (299)..(299): n is a, c, g, or t
  misc_feature (411)..(411): n is a, c, g, or t
  misc_feature (414)..(414): n is a, c, g, or t
  misc_feature (518)..(518): n is a, c, g, or t
  misc_feature (751)..(755): n is a, c, g, or t
  misc_feature (773)..(775): n is a, c, g, or t
  unsure (1)..(785): unsure at all n locations
cccgcnnnnnnnnnnnnngagccgagaagccgccnnngctcctcctccgtggcctcgcgcagctctactcccgcggcgccgccaaccagcagctgccagagaagctcgtcgctgacctccgccgccacttngncgctctccccaacaggtcagtgtcccaaagtcgccacctttttgcatatttttncccccttatgccactacccaattctgcaacaaaagcgaggtntatattagtcaacagacttttttncctctttgggtgaaattttgcaattnctatagagagataaaacatnccagtgcctctatcgatgacacaaatctgctgcaacccgagattagtttcgtaagcaactaagagacggatctctgttctgccatctttgtttttaacttccagagatcacnganctttcgttaccgtgtttatgattaaatcaagcacataatttgatatctaataagctaaggtgacagtgcatctctctctggctctgctgaatggttgctgacangcagaaatttcgattttgcagctacgcacaggcaggatatgacatgaaagatgtcctcctgcatgcccgccttgcagagcaggcgacaggtgaggatcagcctgcagtgaacattgaggaagttcatggcagaggaagttgtgaagaaggcactgttttccagctaacatttgcttgcacagccccgctctcatggcagtcaatgtcaggatcactagacagcccttcgttcnnnnncaagaagatccagatctnnngaagagaggg

SEQ ID NO: 1270 - DNA, 587 bp, Zea mays
  misc_feature (16)..(16): n is a, c, g, or t
  misc_feature (22)..(22): n is a, c, g, or t
  misc_feature (45)..(47): n is a, c, g, or t
  misc_feature (116)..(116): n is a, c, g, or t
  misc_feature (169)..(169): n is a, c, g, or t
  misc_feature (247)..(247): n is a, c, g, or t
  misc_feature (281)..(281): n is a, c, g, or t
  misc_feature (410)..(411): n is a, c, g, or t
  misc_feature (566)..(566): n is a, c, g, or t
  unsure (1)..(587): unsure at all n locations
ctcaaacccatagtcnaaatanaattttgtaatagctcaccttannngtttctgatgtcccactcccatctgttactatctgtaatgtgtttatgtttgttggcacctatcatttntgcactttctgttggaatgattattattagtttgtgcttttgctttcatatgnacaataacgaattgccatttatttgagcaccccaatggcaacttgtccttgttcatttcaagtttcaaatcttttttngtgcactatatcttgataagtaatcaatgatctntcactgaaggccacatgatcttataatgacatggatatgattagtcttattaggtgccactctgtttgcaatgttattcagaacgtagatgcactgcttgctgtcctaatttactgattgacatacttnntctggttttagattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttgggtaatnatcggcattcttttgctaaca

SEQ ID NO: 1271 - DNA, 533 bp, Zea mays
  misc_feature (227)..(227): n is a, c, g, or t
  misc_feature (231)..(231): n is a, c, g, or t
  unsure (1)..(533): unsure at all n locations
ggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtctcgcgggagctccgcgtgggncccntcgccctcagcgtgttccgcctcacgtggcggtcggcgttcgtgtgcgtcaccaccgtcgtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagc

SEQ ID NO: 1272 - DNA, 723 bp, Zea mays
  misc_feature (627)..(632): n is a, c, g, or t
  misc_feature (646)..(650): n is a, c, g, or t
  misc_feature (659)..(660): n is a, c, g, or t
  misc_feature (666)..(671): n is a, c, g, or t
  misc_feature (676)..(676): n is a, c, g, or t
  misc_feature (678)..(681): n is a, c, g, or t
  misc_feature (685)..(686): n is a, c, g, or t
  misc_feature (688)..(688): n is a, c, g, or t
  misc_feature (694)..(694): n is a, c, g, or t
  misc_feature (696)..(696): n is a, c, g, or t
  misc_feature (703)..(705): n is a, c, g, or t
  misc_feature (707)..(708): n is a, c, g, or t
  misc_feature (711)..(717): n is a, c, g, or t
  misc_feature (719)..(720): n is a, c, g, or t
  misc_feature (722)..(722): n is a, c, g, or t
  unsure (1)..(723): unsure at all n locations
acagttgatgggcaacatgacacactagtagtgagtagtagggactatagcttagttaatcaccagaaatggcaccacaaacttgcctctgataattgcattttctcttaaggaaccttgcttgtgatcaaacatgttcaaaaatatataaggagcatcactcttttacattatattcatgcaaatacatatgacagtcaggatcctctcttcaagttcaagccgatggctaataagatgatgccagtactggatagggaaatgacatatacattcttaaaaaaggtagaactttcattggacatgctgggggtagggtcacatcatgcagctaattttactaaaatattgaaccttacccttttctttcttgacaaatcaccatttcatactaaactatcactagagacttattttcttctttggtgtttgcaggctcacacgtcaaagtcattgcaggtactgctcctaatcaaacattccttcaattcaaaatggcaaaggatgtctattagccacaaattcttatctttctcgactatggctctaaacattttctcgaacccattaataacaccaaatggtgccttcttatccaaacagtatattgatttcctgttcactgcnnnnnngctacatcatcggnnnnnacaatagtnnttcttnnnnnnatggnannnnctgnncnctatcntncacttannncnngannnnnnnannana

SEQ ID NO: 1273 - DNA, 1220 bp, Zea mays
  misc_feature (99)..(99): n is a, c, g, or t
  misc_feature (173)..(173): n is a, c, g, or t
  misc_feature (195)..(195): n is a, c, g, or t
  misc_feature (233)..(233): n is a, c, g, or t
  misc_feature (271)..(271): n is a, c, g, or t
  misc_feature (275)..(275): n is a, c, g, or t
  misc_feature (292)..(292): n is a, c, g, or t
  misc_feature (328)..(328): n is a, c, g, or t
  misc_feature (410)..(410): n is a, c, g, or t
  misc_feature (417)..(427): n is a, c, g, or t
  misc_feature (429)..(429): n is a, c, g, or t
  misc_feature (656)..(656): n is a, c, g, or t
  misc_feature (693)..(694): n is a, c, g, or t
  misc_feature (749)..(749): n is a, c, g, or t
  misc_feature (814)..(815): n is a, c, g, or t
  misc_feature (932)..(932): n is a, c, g, or t
  misc_feature (971)..(971): n is a, c, g, or t
  misc_feature (1006)..(1006): n is a, c, g, or t
  misc_feature (1132)..(1132): n is a, c, g, or t
  misc_feature (1183)..(1183): n is a, c, g, or t
  misc_feature (1198)..(1200): n is a, c, g, or t
  misc_feature (1203)..(1210): n is a, c, g, or t
  unsure (1)..(1220): unsure at all n locations
tttgggagctggccttatgaaaaggtggtttgattatgccattcgctcccttagaatttttttaatatggttagaagtacactttttattggcttgtanattctctctaacaatgcctgtacaatatttctcttctactactattaatatctagaacaataggggctgcccanactgtagtgctttaaaaagaancaatttcagagttattttagaattttgaaaaccatttnattattatgaaagcaagttattttagaacattcaaacncaancaatgatttttttctgncatgaaaagttcattcatgttttgatgagttttttnaatgcaaattaactttggatcaacatagcaacttagcaagcaatttattctacaacttttttgttctcttttatctgaactntgaagtnnnnnnnnnnngnctgtgatgtgggaatagaagagctcaccaagaacatgttggttaacctttattatgtagtttcctcagtttattatttcttgatcccagtccctcgaagagctcacaaagatggcccataatttctatgatgagactgcactcccaaagctggtaagccttgttttagctattttgttaattttctttaaaattttgagtcacttatagcaacattcgctactttanctatcttgtcctgatttgttctttaattaccctatannaaactcttgttatggtacatgatgttgagttagtttacttaatagtatcagagtngtcattctcaagcatatatgatcttgggatgttttattcccatagtacttaattcattttttttnncttggaatacatttcgtacaggtggctgatttcgcgtcccttgagctttctcccgtggatggaagaaccatgaccgatttcatgcatacaaggggacttaatatgtcctctttaggncgtgtggtgggtgtaaattttatgcctaaatgcttttcntactatgtttggacaaagttgcataataatctganattgtttctttatattaatcaggtagagctagcagagaagctcccacacatccagtctatatgcattcatgaaatggttattagatcctttaagcacatcgtccgagctgttattgctgctgttgntgacatgcaaaatatttctgcagctatagctgaaactctaaacatattacntggatctcccagacnnnaannnnnnnncacagatgcc

SEQ ID NO: 1274 - DNA, 673 bp, Zea mays
ttctccctcacgacaccgaaggagcacgccggctctggaaggaatttcctgccatcccagaggtatgcacttcctccttttggcaaagctagagtttccttgctaattgtcttgccttgtacagttgtactgactagtatggattgctgattgagcctttgtcgtgaaatgtcaggctgccgatttcctccctcccgggaagcaagcaagggctttcttctagacgagctcttctggttccttaagtttgtgggccgtggctatttaatctccaactgcatccccagatattcaccaaattctgtgagactgggaactccgggattggtttggataaggtgttctgggaatggggaaccaatgcccaaacgggacccttgggagtgactactacaaccgcccggcgtccaggtttgccgatggttgtcttgaggacgatcgctactctgacttgaagaagtttgacaagccatggcctgaggtgaactcgtttaagcccactgctgttggtattttgaagaggggattggatccaacgtcaatcactgtccttgaaaggaagacggccgacataagggaacattatatcattggtcggaggcttggtcaaggccagtttggcacaacattcctctgcaccgagatcagtacagggtgtgagtatgcatgcaag

SEQ ID NO: 1275 - DNA, 1264 bp, Zea mays
  misc_feature (104)..(104): n is a, c, g, or t
  misc_feature (108)..(108): n is a, c, g, or t
  misc_feature (135)..(140): n is a, c, g, or t
  misc_feature (160)..(160): n is a, c, g, or t
  misc_feature (196)..(196): n is a, c, g, or t
  misc_feature (226)..(226): n is a, c, g, or t
  misc_feature (248)..(248): n is a, c, g, or t
  misc_feature (304)..(304): n is a, c, g, or t
  misc_feature (319)..(319): n is a, c, g, or t
  misc_feature (323)..(323): n is a, c, g, or t
  misc_feature (325)..(325): n is a, c, g, or t
  misc_feature (489)..(489): n is a, c, g, or t
  misc_feature (669)..(671): n is a, c, g, or t
  misc_feature (675)..(679): n is a, c, g, or t
  misc_feature (681)..(682): n is a, c, g, or t
  misc_feature (699)..(701): n is a, c, g, or t
  misc_feature (704)..(704): n is a, c, g, or t
  misc_feature (708)..(709): n is a, c, g, or t
  misc_feature (715)..(719): n is a, c, g, or t
  misc_feature (721)..(721): n is a, c, g, or t
  misc_feature (725)..(726): n is a, c, g, or t
  misc_feature (728)..(734): n is a, c, g, or t
  unsure (1)..(1264): unsure at all n locations
gagctcttcctgggtggagtcagaatcttactgtcatccttattcgatggtttctcttctgctaatgattttcgtctgggagtctgaacatgggagaatcaacnaaanggttatttactaaacatgctgcatggnnnnnnacataagacattaatagggncactgatgagttgaagcaatactacagtctacatgntcctaacaagagacacatatggtcaggttnttgatcatatattgatgaaaangttcagaattgatgttgttgatcctacattgatgaaaacttcacaagtattatatncccatgctgtatatnacangncattgttgacacttaccgaagagcttcgattttcagacttcttttcagctttggcaggctttgaatccgaattgcctttgtccttcgcatctgctttcccttcccagcttcttctcaaggccttgggcccagattcgaagctcaacaaggtgttactaatgganttacccagggaggacttcctccctgccgtagtggccttcaacacagacgcagccttttctagcaaggacagccttgacggcggcgatttctctgctcctttggttctcactctctgtttcatgtcactcgagaatttatcgaacgacgcaggcagagaatgggcgctggtcggggaagannncgtnnnnntnncgctggttgattttgcnnncgngctnnccacgnnnnncntgtnngnnnnnnngccattgagcgcctgtttcgagaggttggagttcgacttggtgagctggggcttcttgctctctgtgccgttgctcttgggaggagcattgatcttctctaacctgccctgctctttctctagcgacagggcaccggcatccttggaactaccattggtggaggaggcttgggcggccttgccgctgccaagaagaaaagtggaggagctggtcaccacaagatcctccgggctgccgacgcaggcatggcggcccgggaccggcctgacccccctgaggatcggcaccggggtggctgcctcgagacgatcgacatggacgaactgccccagctggatgacgtcgctcaggatgaggtcgtgctgctcgtccggcagcgacacgtaggtggcgtgcgacgagtcggacaccttgaggtagaacccctggttggtgaacaggtcgctcccggcgagcgcgggcacgatgctgacgacctggagcagcgacgaccggtgctcgcccgcgaccttgacgtcgctgttcatgt

SEQ ID NO: 1276 - DNA, 245 bp, Zea mays
gatgtcagcaagattgatggttgctaacaatgaccttgtgctgtttcttaccgggttttgacgtgttggatttgtgattaccactgattgctattgtacttcaaacaggaatggctggaaatgcaactcggcttctcttgagaccttgtcatttgctgtagttcgttcgcaactgtatattgtagcttggaagactctgtgccgtggtgcgtgtatttgagaaatttctatgcaaagtgagctgg

SEQ ID NO: 1277 - DNA, 357 bp, Zea mays
agcatttgtcaaaaccgcgacatgataagacccacaagcaacctccacaacaccgccacccccaagctgctcttcgaccaggcgaggataccttccatcattatttggattgccaagctgtccatacacagggcttccaacagtaaaaatgtgccctgaggtagtcaacccaatcgtaagagtatggccacatgcagccttatggaagttgtaatctatcaacgaagggacgcatgttggtttcagttttgaagacctatcaccatgacccaggcgatatttgtctccatcaccccaagtgaacaactttccagatgaagcatttgactgtgaaatgataacctcaacaacagcagc

SEQ ID NO: 1278 - DNA, 531 bp, Zea mays
  misc_feature (169)..(170): n is a, c, g, or t
  misc_feature (233)..(234): n is a, c, g, or t
  misc_feature (249)..(249): n is a, c, g, or t
  misc_feature (253)..(256): n is a, c, g, or t
  misc_feature (275)..(275): n is a, c, g, or t
  misc_feature (344)..(345): n is a, c, g, or t
  misc_feature (352)..(352): n is a, c, g, or t
  misc_feature (362)..(364): n is a, c, g, or t
  misc_feature (369)..(369): n is a, c, g, or t
  misc_feature (379)..(379): n is a, c, g, or t
  misc_feature (427)..(429): n is a, c, g, or t
  misc_feature (464)..(466): n is a, c, g, or t
  misc_feature (473)..(479): n is a, c, g, or t
  misc_feature (481)..(485): n is a, c, g, or t
  misc_feature (488)..(488): n is a, c, g, or t
  misc_feature (502)..(506): n is a, c, g, or t
  misc_feature (518)..(521): n is a, c, g, or t
  misc_feature (523)..(525): n is a, c, g, or t
  unsure (1)..(531): unsure at all n locations
tcgtagtataggagcaccagatccatgatcgaatcaccccaaccaccagagccaacttttagctgtaaaaccctgagacagcgcaggtgtcactgggaaaggcagcgcgtaaaaaactacaagtactcagataaacaagcgtattagtacaccttctggcgagaggggnnaggatcggagtggactagatcatgagcttcgagtatgctttaggtgcacacacacaaagaagnnggaatcgaaatgggnaccnnnngtggtagccttggccatanaaaactggcggcatgataaccgtcctagaatctgagcacacacttttccggtgccggattttatattgnngtcgccnaaaaaaaaannncgctnatgcaaagangagatgcttagcggttcgacgcaatgatctaataagtgtactttattnnnaatcaaaccgagtaaaaaggcgaggagaacatgannngttgggnnnnnnntnnnnnaanggaaaaaaaaagannnnnaaaagaatgctnnnnannntttaca

SEQ ID NO: 1279 - DNA, 390 bp, Zea mays
  misc_feature (37)..(37): n is a, c, g, or t
  misc_feature (167)..(167): n is a, c, g, or t
  unsure (1)..(390): unsure at all n locations
tatcagtattgttttcaacctcgaaatactctccaanggatcaatcaacataatattcattactgagtttcaggatcacctgaattgcaaaacggcagttcttccggtagtgcagggcaatgtttcaaccctgcttttgttcattcagtagcagtttctgaagaggntattttgggagggctctacaaggtttgtgctgttgcaaggggggatggtgctgttgatgtggttgatcttgagtatgaactggcccctgcgaaatcgaagggacctcctcgggcagctattttgacaacgagatcaaaaggcgctgaacttggagatgggagctgcaatcaaagtcgagcgaaaagaatccatcttgactacaccatgggcggccatactgca

SEQ ID NO: 1280 - DNA, 410 bp, Zea mays
tcgttaacaaggagaggagagaacgggtttcgtggaccgggccggtcttccactatgggcttgttaggacatacaaagacacagccgaaatttgctgttggtctcgagcaaggccacggcccacaggtctgcttgggtttgggtctaggaaaggaaaagaactactctcactaaaatgagagaaaggtgcggtaaaaaatgagagaaaggtgcggtaaaaaaaaccaaaaagagagaaagatgaaaaagaagacttcaaacgcactggcatagacgccacggcagtccagtggcaaccgcatcagtgcgtatttacggagcaaaacagatctccccgtcgacctggtacacagccgcagttggtatcaggacgtcgcacggcaggtcacgagtcttcagagttcagagag

SEQ ID NO: 1281 - DNA, 497 bp, Zea mays
tgtgcttgctttacccattcggtggtgaggcgttggtggcgcccgcggccgcggccacgctcgatagggcgtcggccggtgacgagctcgacgaggaggacgccgaaggagtagacgtcgctgcggtcggtgagctggcttgtgcgcaggtactcagggtccacgtatccggccgttccctttactagcgttgacacgtgggtcgcttcagggttttcgggggctaggcgcgcgaagccaaaatcggcaacctttgctcgcaggtgctctgttaggagaatgttggacgacttaatgtctcggtggatgattggatgatctgcttcccatcgtaggaaaatatttgtcagacataaggatgctgaaggtttggtatccgcagtagatgtcaatacatagacatgttggtggctgtcatacaaaattctgatcatggaactgagatggtgattttcatgatggttgtctcatctagggaactgatactgaaatgtacc

SEQ ID NO: 1282 - DNA, 525 bp, Zea mays
  misc_feature (22)..(23): n is a, c, g, or t
  misc_feature (27)..(27): n is a, c, g, or t
  misc_feature (145)..(148): n is a, c, g, or t
  misc_feature (200)..(203): n is a, c, g, or t
  misc_feature (221)..(221): n is a, c, g, or t
  misc_feature (241)..(241): n is a, c, g, or t
  misc_feature (265)..(265): n is a, c, g, or t
  misc_feature (269)..(269): n is a, c, g, or t
  misc_feature (295)..(295): n is a, c, g, or t
  misc_feature (308)..(310): n is a, c, g, or t
  misc_feature (394)..(394): n is a, c, g, or t
  misc_feature (398)..(399): n is a, c, g, or t
  unsure (1)..(525): unsure at all n locations
cacggctatttctacatgccanntgtncatatatatagtaagcatatatgaaggatcacgtctcaattctcatatgtcatctatgtacataatatacatactattaatatgttttttaaacaaacttaacctgcggctagctagnnnnaacctcccacgcaagttgataaaatctttcttagacctcaccatccatatannnngctagcatgcagatgcancatcactcctcaattcacanaagtcatcaaccttctcatcaggnagantgagaaaacccttcttaaacatcganaaaaccatacttnnnagagacctgtgcttcggcggagtcgaacttagaacataagaaataagaaatgcaattcggaccatctaactaactcagcacatntatnntattaataagtctaaccttcgtgtggcacaaagaagccaagcagcacagtgagtcagttgggtataaacttgaagcgaggcttggaaaacgccggagccggatcgtagcgcccataatcatttgtc

SEQ ID NO: 1283 - DNA, 449 bp, Zea mays
cctggatatagctgctcggcgctacagagttccatggtgagttttgtgacgatggagcatcatccatttgctcattatactttgtattgaacgatatcttgcttgtcagggcgcagactgccattgacatccttgcgaagcgcgcatactcccacgagacgaagatcagcagtggttgctcggctaaggtggtcagtcggcagatccgttggtgtctgtctgatccccgcttctcccccttggcaggcgggcggtagcatgatgatctggttgggttcaacaaggacggcgctcgcctgatccatccattgcctatgcctggcctgggactcccatggtccatggatttcggtgcgtgtgatgaatgcggacgacgccagggtttcttctttgggcttcggcgagcgacacgggcgtgggagctgctgtttttgtgcttggatttccgt

SEQ ID NO: 1284 - DNA, 409 bp, Zea mays
  misc_feature (41)..(41): n is a, c, g, or t
  misc_feature (324)..(326): n is a, c, g, or t
  misc_feature (407)..(408): n is a, c, g, or t
  unsure (1)..(409): unsure at all n locations
agcaaaattggtgtggcctggaaagtgcttgcagggccttnacatttgcaccccaggttacagtgctgctgaaatcatatagcctgagcttgtaaagatggtaaccatctcattctacagcaacacctaacctgccattatgcgcagatgggtcggtgtcggcaactcattcagttgataccagaaggaaaggtggatgctctcggtcaatacaatcagaaatgagaagcgctgaacgaaggagcagttgctgtttaagaacgactcctgccatcacaagagttgctggactctaccatacatgccaatgtcagatgtagatgnnngaggtttgttaatcacctgaacttccaggagccaatgttttaaatggtgatagcatttcagattttccttatctcgcctgnng

SEQ ID NO: 1285 - DNA, 1157 bp, Zea mays
  misc_feature (91)..(91): n is a, c, g, or t
  misc_feature (98)..(98): n is a, c, g, or t
  misc_feature (399)..(399): n is a, c, g, or t
  misc_feature (415)..(415): n is a, c, g, or t
  misc_feature (482)..(485): n is a, c, g, or t
  misc_feature (506)..(507): n is a, c, g, or t
  misc_feature (536)..(546): n is a, c, g, or t
  misc_feature (555)..(559): n is a, c, g, or t
  misc_feature (561)..(570): n is a, c, g, or t
  misc_feature (593)..(597): n is a, c, g, or t
  misc_feature (630)..(631): n is a, c, g, or t
  misc_feature (635)..(635): n is a, c, g, or t
  misc_feature (637)..(637): n is a, c, g, or t
  misc_feature (642)..(642): n is a, c, g, or t
  misc_feature (644)..(653): n is a, c, g, or t
  misc_feature (659)..(661): n is a, c, g, or t
  misc_feature (663)..(675): n is a, c, g, or t
  misc_feature (678)..(695): n is a, c, g, or t
  misc_feature (697)..(738): n is a, c, g, or t
  misc_feature (755)..(761): n is a, c, g, or t
  misc_feature (777)..(777): n is a, c, g, or t
  misc_feature (779)..(784): n is a, c, g, or t
  misc_feature (788)..(790): n is a, c, g, or t
  misc_feature (792)..(798): n is a, c, g, or t
  misc_feature (803)..(810): n is a, c, g, or t
  misc_feature (816)..(822): n is a, c, g, or t
  misc_feature (890)..(890): n is a, c, g, or t
  misc_feature (975)..(1014): n is a, c, g, or t
  unsure (1)..(1157): unsure at all n locations
aacagcaaagtaacagaaatcaggaacataccattacaaacaccatcacatgtctcctgcatttcgtcataggttcctcggtgcgattcancttcganaaaccaacgtagatccgtccggtccgatgccactgcacaattcaggtttaagccttgagaagtgaggacagtttacccgtgcgaaggcgtgcgattcaaggccgctggtgaggaggtcagcgacgtccttcttgaggaacttgaccatcgcttgcttcttccgccgcagcagatccagccgggtccgggtgcacttgatcgcgtgcttgctacaccaaacagcaactaaatcagcggttggggtagtagaaatcaaacaaatacaggtgacaggtcaaatcgagaatgcaggaatctgganaaacagcgggaaagcngaacacagatcaagaacaggagcaggaacgctcgcaagtccggggaacagttccttggattcgcagnnnnagatgagaagtggagctaaannattcggatcgagggacgagcggaatgcgnnnnnnnnnnnattcgcccnnnnntnnnnnnnnnnaaacagaaaagctgaacagatcnnnnncgaaggaagctcaaaacaatcgatttcgagctnnggtntncaganannnnnnnnnnaaaaannnannnnnnnnnnnnngannnnnnnnnnnnnnnnnnannnnnnnnnnnnnnnnnnnnnnnnnnnnnnnnnnnnnnnnnntaccatttgttgtagannnnnnngttgagcagactgtcnannnnnntgcnnngnnnnnnnggtgnnnnnnnntccccnnnnnnncgcttctctctgctcccttctcttcggctcttctcctacagctccgccctcggcttttagccagtggnagaggaggtggtgggaggcacgcagagcggcagaggcagaggcggggcggccaaagctgctgcgagctgtggcgtcaaagcatcnnnnnnnnnnnnnnnnnnnnnnnnnnnnnnnnnnnnnnnngtggtggactggtggtggtggtggcctggtggagtgggggaagatggctgggtggaggtagtggagaaggaaggaaaatatgagctgttgatgaggagaagccaggtggccatgaccagcaggtatcattctgctgcatgcac

SEQ ID NO: 1286 - DNA, 772 bp, Zea mays
gggaacgggtgcccttaatgctttccggcaatcaaatttcaatgctgtaggcttgcaaggctacaaggtatgctcagcatttggtcatcagtttctgctaccaggcatttatatattcttcagaactattctgaaattcagtgcttttggctttagaactgttattataatgatgcatttacaacagagtttaggaacatgtactttaaaactttgggttcatttttaacctgttcgatttggtatattctatattgttatgcagcttccagcagattgtcgtttggccgctgtatttgttgctggtctttcgctcactggtaccgtttgtgaacttgtttcttctttctaatttttaatctgttgcattccaacatattttatgttgttgcctgtgaactcaatgcagaagacggtgaaagtgacgagcaggttgttttggttagccagagtggcactgtaaacagaatcaaagttaaagatatatccatccagtctcgacgctcgaggtaagctaggcttcaatgctctaataaaagcgtgtagctggttccaattcattaccttctcgtttcccttccgactttttcaaccatgatctacctctgttgggcaactaggggagtgattctgatgaggctggagcatgccggaaagatccagtcagcatcactgatatccgcagcggcagcagaagtaactgaagattagtcttgcacccaagatgcaagtagtttagtctgaatttaatccctggcgtacgctgcagcat

SEQ ID NO: 1287 - DNA, 512 bp, Zea mays
tggcggcaggcagggaggttctattaccgccgcgctgttcctgaaacaggtacatttctgtttgtttttttcttttcttttgacacgcctaataaatacattatgaaatttgatcagagcgataggaccattggagtggtgagagattaagaatccgccacgatagtgaacactttgacaggacagacttccagagcagtggtaacggcatgaacgccgcttttgtgtccctcccttgttgcagttcgtcgacgacaaggtccagtggatgcacatcgacatggccgggccagtgtggagcgacaagaagcgggccgccaccgggttcggcgtttccaccctggtggagtgggttctcaacaactcgtcctcgtcgtgaacaaaacccatacctcccctcgtatcacaatgcctttccatgcgtttttattttgttcctcctcttttgtgctaccattccatagttgcaaactgcagagcgcctcttggcatgtgataccgttgtgatagaa

SEQ ID NO: 1288 - DNA, 715 bp, Zea mays
atcgattatgacctggctgtgctcatgcagcctatgctaatgcttgggatcagcattggtgttatttttaatgttatattccctgactggctggtcacagttctgctgataattcttttcctaggtgcttatcttgtaccgattcccaaaactatgaaatagctcatttattgttcatgaatgaccttacaccttcaaaattgatgacaggcacatccacaaaagcctttctgaagggcattgagacatggaagaaagagacagtaatccaaagggtaatcttttgtgacttccttgtctcctttgttaacaatgaggctttggcttacatatatatttttttacatcctatgatatagtaatgtgatagccttcttttcttccaggaggctgcgaaacttttggagcaaactgcaggtaagagagagagaaatatatgtgctcatctgtcacaaatactggatctattccttaccttttttcaaccgttcaggtgaggaagcagagtatgcagcacttcctactggaccagatgttgcaccaaacaaaaaagccctcacatcagatgaggcggtaaacatctaatgatcatatgtgtactcagctgcactcttttgaaactatagttgtaaggattttaatctagaaagtttccactgtttcagccatcgcttataaagaacatacactggaagaaggttggtcttctttcatt

SEQ ID NO: 1289 - DNA, 357 bp, Zea mays
gctgcggttctttgtgaagggggaggtggcattcgtgatggcgcacatgaggcggtggaagcgcacggacaagaagttcttcggcagggcgagaaagctgttcgacgttgaggtggttcacgaggatccaccgctcgagggctggcggcacgggccggtggtttaccggttcaccgccaagaagcagcacggcaagaagtgaagaaactaccttaaggtaaaggctgcttgcttgcctatctgcatgtgttcatgttgcagcgctgctgctgctactgtttgtcctcgtttgttgagtgctagattccaatgttggaaacagaaagtagttccttggaacaatgtgcaactctggac

SEQ ID NO: 1290 - DNA, 428 bp, Zea mays
  misc_feature (418)..(423): n is a, c, g, or t
  unsure (1)..(428): unsure at all n locations
aactacgattttgctgagaaccagtctaattaaactatggctgtgcatagaaccagtctgatcgtcttatactaatttgttcgttgctatttgcttcgacagctacaacgttgactggacttcatttcgcgatgacgaccttgatgacattagtaatgaaatggctgggatatattcagccgtcctatctaccgttacctgaactagtaaaattcgcattttttgcgaacctgtctattgttgggatgaatgtaagcttgatgtggaactctgttggattctatcaggtgcagacagaaacttcgatattctataagtatatcggaatgaaactcgtatactgacgctgtctgtcttgccttttttttcagatcgcaaagctgtgtatcattccagtcttatgcattctggaaatcannnnnnacaaa

SEQ ID NO: 1291 - DNA, 460 bp, Zea mays
tgtttggcggccgcgggttcgtgcccttctcccctggatcgcccactgagcagagcgtccacgacggacggtgaacaaagccgcgtctgacaccaagagacgagcaggacatgcttttggctgctaatcgtcagatgatgatgtttttgtttgttgacagcttctgatggtgcgttagcaatggcaacgaggtgtcagttggtttggattagcaggatgaagaagagcaaccctggtaactagggcggggggattgagtttgtgcatgacaaggctgcaaacttttgtatgtagataaaaaaaacacccatttggccatttgtattgtatgttattgtatgtaagctagcaggcctgtacaactgcttttaggtcttcgtttggatgggcgaaattctggcaaacagcagcacatccactctgtgttctgatctaagcatcttggtttgattttgaaatg

SEQ ID NO: 1292 - DNA, 529 bp, Zea mays
  misc_feature (125)..(126): n is a, c, g, or t
  misc_feature (130)..(131): n is a, c, g, or t
  misc_feature (135)..(136): n is a, c, g, or t
  misc_feature (139)..(139): n is a, c, g, or t
  misc_feature (141)..(142): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (151)..(153): n is a, c, g, or t
  misc_feature (157)..(157): n is a, c, g, or t
  misc_feature (159)..(160): n is a, c, g, or t
  misc_feature (162)..(162): n is a, c, g, or t
  misc_feature (165)..(165): n is a, c, g, or t
  misc_feature (191)..(191): n is a, c, g, or t
  misc_feature (389)..(389): n is a, c, g, or t
  misc_feature (503)..(503): n is a, c, g, or t
  misc_feature (510)..(511): n is a, c, g, or t
  unsure (1)..(529): unsure at all n locations
gtaagcgaacgcgatgttgccaagagcttgaagcgcgagccagaccttctgggctgaatcaacgtcgactccgatctcagtgccggtcagagtggtcgtaccactacggcctgcagtgacaacanncacnnaatnnatncnntnanancgnnntgtngnnanganctttatggagtaaaatttatctactngctagttcacctgaaatggtccgcgccaacgagaggccgacggcgatgctagagtaagagaacgacatgatggcggcgacgatggacagccacgaaaggtcgctgaagttagggagctgagagaagaagatctgaacgatcccaaatacgaccatgtacatggtgtcgtaggtgctgcagtcggccgcgtggcccttnttgtggaagcagtttgccttgtgcacggccctgctcatcgccattcagccaaaaggggtttctcaatcgacgatgagactgaatctgccaaaacattcactactaaatgagccnttttttnngcaagaattactcacgct

SEQ ID NO: 1293 - DNA, 377 bp, Zea mays
gcgtcaaggagtgcctggtaaccgagggaagcttttttgaccgtggcttcaagaaatacctggtgcgaatcgagatcataggagaagatcgggaggcatccaccataagatcaactattgagtacgaagttgatcaggagcatgcaggcaacccccctgttgccagtgccagtggcttggctatcgctaagccgctaaggccatcgtagaatatatcatcaagcagaagaagaaaggtcctcctgagtcctgagtaattaagctcacatcacatgtaatcaactccgggaagaaaggatattatattatatcgtgtatatgtttgatcagtgaagaaccgaagttaatttgtgtctaccaatgaacaaatagaatac

SEQ ID NO: 1294 - DNA, 713 bp, Zea mays
  misc_feature (683)..(685): n is a, c, g, or t
  misc_feature (697)..(697): n is a, c, g, or t
  unsure (1)..(713): unsure at all n locations
gcatcaattgacgcacctgcatagggccaaactattctaaatcacttgcagattcagtgtcataccttttctagctgctaggaacttgtagtgttagtgcaacagtgtgctctgatatttgtgtatgtctgtttctggcctccataaggagtgctttgtacctgggtttttactgccctttttccccctctactttaatatatgggtgcgcagttctcctgcgctcttttcgggaaaaaatgcacccgtttgccattggtcatagtttgtgtagcatgttgcagagatctgcttgcacctgttttgcatttcaacttcagcttattggacatgatagttattgaagatgccaaattttgtttttttttaaaaaaaaaaatctcatgttctgtggatgatctgcagattctgcctaatcctacatggctgagcaagtttccttagcttactaaactggcgtgctaacaagtgacacgtgtcaattgatgggactgactgaatcacgggatgacccaaagaagtaactctccatctgtatacccctcaccccaatatgtacagaaggaatctcaactaggaacctagaatttgcacaggaaaaaaaaacaggtgtgctagccatttggcaatcagtgccagtttatctgttcctccacagttacatatcccacccatggttgagnnngagctgcaaagnccgttggaattatctt

SEQ ID NO: 1295 - DNA, 389 bp, Zea mays
  misc_feature (376)..(377): n is a, c, g, or t
  misc_feature (379)..(379): n is a, c, g, or t
  unsure (1)..(389): unsure at all n locations
actgacagagaagagtgacgtctacagcttcggtgttgtccttcttgagatcctcaccggccaagagcctctcaagttggatgggcctgagacgcaaagaagcttgtcgtcgaagttcttgtccgctatgaaggagaacaatcttgatgcgatcttgccgagccacgtcaacggacaagggagtgatgaactgatcagagggctcgcagagctagccaagcagtgcctggacatgtgtggcagcaacagaccgtccatgaaggaggtcgccgatgagcttggtaggttgaggaagctttcgctgcatccttgggtacagatcgatgcagacatgatagagactcaaagccttcttagtggaacaacggctgctagnntngaaatagaag

SEQ ID NO: 1296 - DNA, 384 bp, Zea mays
atcattcctttatctattggaaatctcaaagggttaaatgtctttgatgcacatcattgcaacttgggggggccaattccagcaagcataggcaacatgtcgaatctgttgacacttgatttatcaaagaactccctcgatggttcaatttccaatgagattttcaaactgtcatcccttgacccttatctatttaaagttttaaacttatcatacaattcgctatcgggacatcttccttctgagatgagtagtttggggaacctgaaccaactagttctgtctgggaaccgattgtctggcgagatacctgagagtattggggaatgcactgtgctgcaataccttatattggatatataactcaatcgatggaagcatacc

SEQ ID NO: 1297 - DNA, 725 bp, Zea mays
  misc_feature (707)..(709): n is a, c, g, or t
  unsure (1)..(725): unsure at all n locations
cctaaacggaatctaaagcaattttgttgtattcttgaacgctaactaacgttactgcgatccattcttcttcattctcagaaagctaactagtgtgattctagagggaacgccggtgccctgcctcttcttgatggtggttgccttccaaggcctcccatcttctctcacactgctggtggttgtcgagctcacgttgtagaactgcatacagacgaagccatgatcagcactgcagcttttcttaagcgggaaaccatggtctcccagatgaagctgttggattttcttcggcttggcagcatactcacctcacaaacaccgtggagcagtagtctctgaaatgggtcctgaacattcagcacaagagcatcgtctttgtcactagcgtcttcaatgaaggccctaacgcgttcctgcaaacatgaaaaaggcagaagcaaggtgacgtgaggaactgagaagctggatgagaagctggtacaagtggcataaatgaaattaagaagatcgtacttctaataagagggaaagaaaactcgatgtagtgccaataaattatctacatgttcttagatagtagatacatacatacatacagatacataatcaaagaactctgatgtcttctttacaagaaaaactaattagccatgatccattataatcatttcggtaaatagaggtcaaaacttgaggaaagaagnnngtctcaaaaaaaaaaa

SEQ ID NO: 1298 - DNA, 1017 bp, Zea mays
  misc_feature (8)..(10): n is a, c, g, or t
  misc_feature (77)..(78): n is a, c, g, or t
  misc_feature (965)..(970): n is a, c, g, or t
  misc_feature (992)..(994): n is a, c, g, or t
  unsure (1)..(1017): unsure at all n locations
cgtgttcnnncgcggggacgaggagacggcggcgttctacgcgcacctgggcgagctgtgcccgccgcccgagttcnncaacaactgctacgccgacctgttccgcgacgtcctggagtactgtgggcgcagctggaacaggcaccgcgccgtgctggtgcacgactacttcagcaacccgtggaccagcatgtccgccgccgccgccgtcttcctgcttgtcctcaccgtcgtgcagacggtctacaccgtgctgccatactacagccagaattaaccgggcaaaaaacaaaaaaggcgttttgccgccgtcacacacaccgggtgtcgccctctgttttttcttttttttgcctgcaactacaagaaaccctatgatttttccttgctggctcctcctatacaatccatatgaatgatggcgtctggagcgtgatcgtttgcttgtccatcgaatccgtgcgcgtccacgatcgcatgaatccgtccaagattaagtaatggaacaacataaaaagacaatattagtaggatgttgaatcattttaaaatgaaaacaagcatcatccctggttttccatattgcccaaagaacaacaccaaatcctaaaataaccagatttatggaatctttatcaaagctatgtaaccaatctccaaacaacaaatctacatcatttggaattgagtttaaagcaatttgcatcactctctaaatatatttagccaacgggcactcaaaaaaatgagatgagcagttgattccaaaagaccacaaaagcagcagctaacagaccctgacattgctttttcttaagattttctttagtgaggattttgtttttcagaattagccataagaacactattattttttttgtggaatcttaattttctacataagtttgtatggcactttaaccgaattacttcttaactgtgaaaacacggacttgactgtgaannnnnnttcacccagaagccagatagtnnnttcatccttttcagagagcccct

SEQ ID NO: 1299 - DNA, 675 bp, Zea mays; identical to SEQ ID NO: 669
  misc_feature (216)..(216): n is a, c, g, or t
  misc_feature (337)..(337): n is a, c, g, or t
  misc_feature (357)..(357): n is a, c, g, or t
  misc_feature (387)..(387): n is a, c, g, or t
  misc_feature (395)..(395): n is a, c, g, or t
  misc_feature (412)..(412): n is a, c, g, or t
  misc_feature (426)..(426): n is a, c, g, or t
  misc_feature (462)..(462): n is a, c, g, or t
  misc_feature (468)..(468): n is a, c, g, or t
  misc_feature (507)..(507): n is a, c, g, or t
  misc_feature (534)..(534): n is a, c, g, or t
  misc_feature (539)..(539): n is a, c, g, or t
  misc_feature (552)..(552): n is a, c, g, or t
  misc_feature (565)..(566): n is a, c, g, or t
  misc_feature (583)..(583): n is a, c, g, or t
  misc_feature (585)..(586): n is a, c, g, or t
  misc_feature (590)..(590): n is a, c, g, or t
  misc_feature (628)..(628): n is a, c, g, or t
  misc_feature (630)..(630): n is a, c, g, or t
  misc_feature (636)..(674): n is a, c, g, or t
  unsure (1)..(675): unsure at all n locations

SEQ ID NO: 1300 - DNA, 653 bp, Zea mays
tatctgtgttatcaaacatgcgtcagtttgtcaagtacagccgtttcaagcaattcgcgcttcgggtaattacagtgattacaaaaaacaacactgcatcgtttattttttcctcacaatatttcctcgtggcatggtcaggctctggcgagcacccttaacgaggaagagctatcagatctgaaggatcagtttgatgcaattgatatcgataaaagtggatcgattagtatcgaggaaatgcgtcatgtaggttctgttagtgtttgctgatgaaaatgccttagatcctgaactactctgcggtgctgattaatctgtgcatgtttcggtaggcccttgcaaaggatcttccctggagattgaagggtccccgtgtgctggagattattcaagcagtaagtttgagccttcttctggatccagccctttctttgttaccccccttgtttccaagaaaatagctggccttgttctgagggtataaccaaaactgcatcttattttgtggtagattgacagcaacactgatgggctcgtggacttcaaggagtttgttgcggcaactctccatatccaccagatggcggagctcgactcagaaaggtggggcatacgctgccaagctgctttcagtaagtttgatcttgacg

SEQ ID NO: 1301 - DNA, 374 bp, Zea mays
  misc_feature (135)..(135): n is a, c, g, or t
  misc_feature (140)..(142): n is a, c, g, or t
  unsure (1)..(374): unsure at all n locations
ctaggagtttttgattggttcattcatcttaaatttagtttggccgctcaaggattatggtttcgtcaagtagttgcctgaatggaacaacaaaacatgcacactactcagtgttccatataaagagagagaganaaaannntaacaagcagcgtcctgcgagccagtgttgcgattccagttcatgcaattggcatccgtaaggggaatgcaagcgcaagacactagagtccagggatgctggtgtaggtagagagggggaacaaggaatttacatacggcatagagatgagagctctctcgtaccattttgtaccttcaattcgcaatgaactttaggcaaggattgccttgggcaattgaacatttgtcgg

SEQ ID NO: 1302 - DNA, 741 bp, Zea mays
  misc_feature (6)..(9): n is a, c, g, or t
  misc_feature (131)..(131): n is a, c, g, or t
  misc_feature (190)..(197): n is a, c, g, or t
  misc_feature (583)..(588): n is a, c, g, or t
  misc_feature (609)..(618): n is a, c, g, or t
  misc_feature (622)..(622): n is a, c, g, or t
  misc_feature (624)..(628): n is a, c, g, or t
  misc_feature (631)..(739): n is a, c, g, or t
  unsure (1)..(741): unsure at all n locations
ctgcannnngccaacaagccctgttaaaagaagtacctaccaaggtgacacataaatcacaagtcctaatatgacacaaaccagcacctggcagcttgttgtcgacaaagaatactactaagtttacagtntacctgcattatggaagaaaaaaaaaacagtttagcagcaaggcagtaccccacagaannnnnnnncagataagtgagagagaagttaaaataccacgcaacaacaacatcgaccgagtagtgcttgcgagaagcaattataaggagactctgaattatagccatgaaccaagcaaggaacttaataaacctgaacacaatacacatagttcagcttcatttcagggatacccacaagagacagtcggaacttgatagggttcaaacaaaaagataagtgcaaaacacaattaccttttcgaaccatatttttggtaagttcgaacgaaaaccagagtgaaaatcatgtgagatgaaaatatcaaatcaccacaaccaaaaagtaccccacgaggaactggaaagggagattcaaattgctggtttatcagagagaatgcgatacagaatcnnnnnnccaacaaaatagacttacagnnnnnnnnnngcantnnnnntannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 1303 - DNA, 372 bp, Zea mays
cagagagcacccgagagaacgacagcgagagcggtaacagcgcgtggccccttgtcccttggttcttcagcgggctgttctcggtacctgaaccgtcgcacactgacagaggcactctcaccaccgatcaacagagtccttccaccaacccaaatgctggaggaaattgatttcgtcatcctttgtgaataatgctcatacatctgagaatagcaaggagccttgtcagtagatggcttattttttttctgtactgataatccttctcggatgaatcgcaaggtacggagtctgtgtctgctctgttttgtcaggattctagcgatcgtttcgcctctagttaatctcatagctactgagactgtctgtctg

SEQ ID NO: 1304 - DNA, 20 bp, Zea mays
ggctcgcacgaatcatcaga

SEQ ID NO: 1305 - DNA, 24 bp, Zea mays
cactaaggacctgcagaaaacaag

SEQ ID NO: 1306 - DNA, 13 bp, Zea mays
cagcgcagagcta

SEQ ID NO: 1307 - DNA, 13 bp, Zea mays
cagcgcagggcta

SEQ ID NO: 1308 - DNA, 20 bp, Zea mays
ccttgagggcaccaaagaca

SEQ ID NO: 1309 - DNA, 23 bp, Zea mays
gctctcttggatgttggccttat

SEQ ID NO: 1310 - DNA, 14 bp, Zea mays
cccagtcgtagtcc

SEQ ID NO: 1311 - DNA, 16 bp, Zea mays
cccagttgtagtccta

SEQ ID NO: 1312 - DNA, 25 bp, Zea mays
acacatcatatgcactcccagaata

SEQ ID NO: 1313 - DNA, 23 bp, Zea mays
catgtacaggttgcatcaaagca

SEQ ID NO: 1314 - DNA, 13 bp, Zea mays
cacagcaacaaac

SEQ ID NO: 1315 - DNA, 13 bp, Zea mays
acagcagcaaacc

SEQ ID NO: 1316 - DNA, 19 bp, Zea mays
gcacccccaccatgtacgt

SEQ ID NO: 1317 - DNA, 20 bp, Zea mays
acgtagacgaaggcgttcca

SEQ ID NO: 1318 - DNA, 15 bp, Zea mays
catgtgcctggtacc

SEQ ID NO: 1319 - DNA, 15 bp, Zea mays
catgtggctggtacc

SEQ ID NO: 1320 - DNA, 16 bp, Zea mays
cagcgcagggctagct

SEQ ID NO: 1321 - DNA, 16 bp, Zea mays
cagcgcagagctagct

SEQ ID NO: 1322 - DNA, 16 bp, Zea mays
cccagtcgcagtccta

SEQ ID NO: 1323 - DNA, 16 bp, Zea mays
cccagtcgtagtccta

SEQ ID NO: 1324 - DNA, 16 bp, Zea mays
acagcaacaaacccaa

SEQ ID NO: 1325 - DNA, 16 bp, Zea mays
acagcaacgaacccaa

SEQ ID NO: 1326 - DNA, 16 bp, Zea mays
atgtgcctggtaccag

SEQ ID NO: 1327 - DNA, 16 bp, Zea mays
atgtgcctcgtaccag

SEQ ID NO: 1328 - DNA, 17 bp, Zea mays
atcgacgatcagcgcag

SEQ ID NO: 1329 - DNA, 17 bp, Zea mays
gacacggttcccagtcg

SEQ ID NO: 1330 - DNA, 17 bp, Zea mays
tacatatgcacagcaac

SEQ ID NO: 1331 - DNA, 17 bp, Zea mays
acatgtgacatgtgcct

SEQ ID NO: 1332 - DNA, 28 bp, Zea mays
gcataggacatacaagagaaacattagg

SEQ ID NO: 1333 - DNA, 24 bp, Zea mays
tattgctcacacgtgcatattgac

SEQ ID NO: 1334 - DNA, 16 bp, Zea mays
tgctactaggaaaatg

SEQ ID NO: 1335 - DNA, 14 bp, Zea mays
ctactgggaaaatg

SEQ ID NO: 1336 - DNA, 21 bp, Zea mays
tcccgaacaaacaacagcaat

SEQ ID NO: 1337 - DNA, 20 bp, Zea mays
cggaaggccctgtatttttg

SEQ ID NO: 1338 - DNA, 17 bp, Zea mays
caactacctagcatttc

SEQ ID NO: 1339 - DNA, 18 bp, Zea mays
tgcaactatctagcattt

SEQ ID NO: 1340 - DNA, 22 bp, Zea mays
gcaattgatcttcctggtcatg

SEQ ID NO: 1341 - DNA, 25 bp, Zea mays
ggttgttctgaatttttgtgacgtt

SEQ ID NO: 1342 - DNA, 16 bp, Zea mays
cgagtcaaagatactg

SEQ ID NO: 1343 - DNA, 15 bp, Zea mays
cgagtcacagatact

SEQ ID NO: 1344 - DNA, 24 bp, Zea mays
cctttagacctcttgcctctggat

SEQ ID NO: 1345 - DNA, 21 bp, Zea mays
gcaagctacctgacgtccaaa

SEQ ID NO: 1346 - DNA, 14 bp, Zea mays
tgcccacatttgtt

SEQ ID NO: 1347 - DNA, 14 bp, Zea mays
ctttgcccatattt

SEQ ID NO: 1348 - DNA, 16 bp, Zea mays
gctactaggaaaatgg

SEQ ID NO: 1349 - DNA, 16 bp, Zea mays
gctactagaaaaatgg

SEQ ID NO: 1350 - DNA, 16 bp, Zea mays
caactacctagcattt

SEQ ID NO: 1351 - DNA, 16 bp, Zea mays
caactaccaagcattt

SEQ ID NO: 1352 - DNA, 16 bp, Zea mays
agtcaaagatactgca

SEQ ID NO: 1353 - DNA, 16 bp, Zea mays
agtcaaagctactgca

SEQ ID NO: 1354 - DNA, 16 bp, Zea mays
tgcccacatttgttat

SEQ ID NO: 1355 - DNA, 16 bp, Zea mays
tgcccacacttgttat

SEQ ID NO: 1356 - DNA, 17 bp, Zea mays
ttttgtactgctactag

SEQ ID NO: 1357 - DNA, 17 bp, Zea mays
tacggaatgcaactacc

SEQ ID NO: 1358 - DNA, 17 bp, Zea mays
gtcatggcgagtcaaag

SEQ ID NO: 1359 - DNA, 17 bp, Zea mays
tggatgctttgcccaca

SEQ ID NO: 1360 - DNA, 1024 bp, Zea mays
acctgaaacacatgccgagttgcctttggttgaggtgcagattcctccagttcatttgcttttactatagttgaaatctcgtcttttgcattggagctggaaaatttgtcataaagtttgagctgcaatagactgagatcacaatatctatcctggattatcttctctggaagatcagataaaacttcatcctttgttcttctcagtagaaacggcatgacctggtacagcatgttcaaatttatttatctacaaaaggtcatttgtaatacaattataaataataaatacctgcttatgcagtgcctccattgcaagaataccagcttcagcatcctttgctgaacatttagaatctttggcagctagcaagggttttccatatgcagcttggaactgtaaaggacaacgggcttcagtacagtatatttcatacaagaacagactcaggtagattcaaagagaacatgtactcagcaggacaaagactgccccaacggtatagtttaaaagaaacatccgttttcaaaaggaccgagacaccccaaaccctgacagttgcagatcttacaccataacctagactgccggctacagccaccagatagagtcccgtcaatacccctagataagaccgcaccactcacatagaccaccgctcacacacgccgactgccaccattaccatagttttatgggttgctagtgagggatgtttttaaacagccttgaaattaatttccacggggagtctactcaagagtcataaccactaggctatgaaatctttcgcggagtaagcacaattcagtttgtttatttacacttcatttaaatagtcttatgtaaacgtagattaacataacaaacatctgttataaaaaaaaaactggattgatctctagtgcaaaaatccagattagagaacagattagcattcccagacaaaacggctaactaagaagctatactagtaaaattgttagatgactatgtgcttatctctactgtaatgagcttggcc

SEQ ID NO: 1361 - DNA, 870 bp, Zea mays
atcttgcatgcctgcaggtccaccgtcatttccaaattcaatgaacctaaatatatgagcgaaaagcattatttcaacattctcaacaataaactggtgcatcaaaagaacgaagtaattgtgcgacaattgaaagagagaaacttaaaagcatcttggggattggagaacatagatgcacataactttggcactaaagatcattggtgaagacccaagagttgtaacagtcaaaaatgaaacccaaaagtgcacaggtcttgatgataaaaagattatgggtctaattaagtgtaagctgcatagaaatcttactacctcattaatggtatgcattttttttggcagacaaacataagaaaaatgagcaatataatagtaacaacagaatttctcttcaactcagccatgtatcagtttttggttagcaaaccataacttcagtatttgaaatatctgataagcagttagcagagtgatatgtttaaagggatacatcagttttacaataaaaaatggatcttcaccaaaagcacaagccaaatgtggcatacaagctagtactgctgagttgtttttaatgcattttctcccactaccatgtatcagtttttggttagcaaaccataacttcagtatttgaaatatctggttggacaccaaaaaacaacactagcagttagcagagtgatatgtttaaagggatacatcagttttacaataaaaaatggatcttcaccaaaagcacaagccaaaaggagagaatgcataacgcgttaatgataagaccataaccatgcaaccgaagctaaggattgtgtttttattggataggatgatatgaacagcggttgaagttatgagttgggc

We claim:

1. A method of identifying a corn plant comprising at least one allele associated with Gray Leaf Spot (GLS) resistance allele in a corn plant comprising:
    a) genotyping at least one corn plant with the nucleic acid marker of SEQ ID NO: 36, and
    b) selecting at least one corn plant comprising an allele of at least one of said markers associated with Gray Leaf Spot (GLS) resistance.

2. The method according to claim 1, wherein the at least one corn plant genotyped in step (a) and/or the at least one corn plant selected in step (b) is a corn plant from a population generated by a cross.

3. The method of claim 2, wherein said cross is effected by mechanical emasculation, chemical sterilization, or genetic sterilization of a pollen acceptor.

4. The method of claim 1, wherein genotyping is effected in step (a) by determining the allelic state of the corn genomic DNA marker of SEQ ID NO: 36.

5. The method according to claim 1, wherein the selected one or more corn plants exhibit at least partial resistance to a GLS-inducing fungus or at least substantial resistance to a GLS-inducing fungus.

6. The method of claim 2, wherein said population is generated by a cross of at least one Gray Leaf Spot (GLS) resistant corn plant with at least one Gray Leaf Spot (GLS) sensitive corn plant.

7. The method of claim 2, wherein said population is a segregating population.

8. The method of claim 2, wherein said cross is a back cross of at least one Gray Leaf Spot (GLS) resistant corn plant with at least one Gray Leaf Spot (GLS) sensitive corn plant to introgress GLS resistance into a corn germplasm.

9. The method of claim 2, wherein said population is a haploid breeding population.

10. A method of introgressing a Gray Leaf Spot (GLS) resistance QTL allele into a corn plant comprising:
    a) screening a population with at least one nucleic acid marker to determine if one or more corn plants from the population comprise(s) an allele of said marker associated with a Gray Leaf Spot (GLS) resistance QTL associated with marker NC0052741 on chromosome 1; and
    b) selecting from said population at least one corn plant comprising an allele of said marker associated with a Gray Leaf Spot (GLS) resistance.

11. The method according to claim 10, wherein at least one of the markers is located within 5 cM of at least one of said Gray Leaf Spot (GLS) resistance QTL.

12. The method according to claim 11, wherein at least one of the markers is located within 2 cM of at least one of said Gray Leaf Spot (GLS) resistance QTL.

13. The method according to claim 12, wherein at least one of the markers is located within 1 cM of at least one of said Gray Leaf Spot (GLS) resistance QTL.

14. The method according to claim 10, wherein at least one of the markers exhibits a LOD score of greater than 4.0 with at least one of said Gray Leaf Spot (GLS) resistance QTL.

15. The method according to claim 10, wherein said population is generated by a cross of at least one Gray Leaf Spot (GLS) resistant corn plant with at least one Gray Leaf Spot (GLS) sensitive corn plant.

16. The method of claim 10, wherein said population is a haploid breeding population.

* * * * *

UNITED STATES PATENT AND TRADEMARK OFFICE
CERTIFICATE OF CORRECTION

PATENT NO.       : 8,273,944 B2
APPLICATION NO.  : 12/201008
DATED            : September 25, 2012
INVENTOR(S)      : Michael R. Kerns et al.

Page 1 of 1

It is certified that error appears in the above-identified patent and that said Letters Patent is hereby corrected as shown below:

In Claim 1, column 45, line 21, delete "at least one of"; replace "markers" with --marker--.

Signed and Sealed this
Twelfth Day of March, 2013

Teresa Stanek Rea
*Acting Director of the United States Patent and Trademark Office*